US008431692B2

(12) United States Patent
Alpert et al.

(10) Patent No.: US 8,431,692 B2
(45) Date of Patent: Apr. 30, 2013

(54) COMPOSITIONS AND METHODS FOR TREATMENT OF EAR DISORDERS

(75) Inventors: Egvenia Alpert, Jerusalem (IL); Igor Spivak, Jaifa (IL); Amir Bar-Ilan, Haifa (IL)

(73) Assignee: Quark Pharmaceuticals, Inc., Fremont, CA (US)

( * ) Notice: Subject to any disclaimer, the term of this patent is extended or adjusted under 35 U.S.C. 154(b) by 0 days.

(21) Appl. No.: 12/994,725

(22) PCT Filed: Jun. 7, 2009

(86) PCT No.: PCT/IL2009/000570
§ 371 (c)(1),
(2), (4) Date: Feb. 25, 2011

(87) PCT Pub. No.: WO2009/147684
PCT Pub. Date: Dec. 10, 2009

(65) Prior Publication Data
US 2011/0142917 A1 Jun. 16, 2011

Related U.S. Application Data

(60) Provisional application No. 61/131,162, filed on Jun. 6, 2008.

(51) Int. Cl.
C07H 21/04 (2006.01)
C07H 21/02 (2006.01)
A61K 48/00 (2006.01)

(52) U.S. Cl.
USPC ............................. 536/24.5; 536/23.1; 514/44

(58) Field of Classification Search .................. None
See application file for complete search history.

(56) References Cited

U.S. PATENT DOCUMENTS

| | | |
|---|---|---|
| 5,898,031 A | 4/1999 | Crooke |
| 5,929,042 A | 7/1999 | Troy et al. |
| 6,107,094 A | 8/2000 | Crooke |
| 6,153,737 A | 11/2000 | Manoharan et al. |
| 6,235,886 B1 | 5/2001 | Manoharan et al. |
| 6,395,713 B1 | 5/2002 | Beigelman et al. |
| 6,602,858 B2 | 8/2003 | Beigelman |
| 7,056,704 B2 | 6/2006 | Tuschl et al. |
| 7,078,196 B2 | 7/2006 | Tuschl et al. |
| 7,087,581 B1 | 8/2006 | Loewenheim |
| 7,452,987 B2 | 11/2008 | Giese et al. |
| 7,825,099 B2 | 11/2010 | Feinstein |
| 7,893,245 B2 | 2/2011 | Giese et al. |
| 7,910,566 B2 | 3/2011 | Feinstein |
| 8,097,710 B2 | 1/2012 | Baulcombe et al. |
| 2003/0027783 A1 | 2/2003 | Zernicka-Goetz et al. |
| 2003/0108923 A1 | 6/2003 | Tuschl et al. |
| 2004/0001811 A1 | 1/2004 | Kreutzer et al. |
| 2004/0038921 A1 | 2/2004 | Kreutzer et al. |
| 2004/0053875 A1 | 3/2004 | Kreutzer et al. |
| 2004/0192626 A1 | 9/2004 | McSwiggen et al. |
| 2004/0203145 A1 | 10/2004 | Zamore et al. |
| 2004/0229266 A1 | 11/2004 | Tuschl et al. |
| 2004/0259247 A1 | 12/2004 | Tuschl et al. |
| 2004/0265839 A1 | 12/2004 | Mello et al. |
| 2005/0020525 A1 | 1/2005 | McSwiggen et al. |
| 2005/0037988 A1 | 2/2005 | Zamore et al. |
| 2005/0042647 A1 | 2/2005 | Baker et al. |
| 2005/0119202 A1 | 6/2005 | Kreutzer et al. |
| 2005/0181382 A1 | 8/2005 | Zamore et al. |
| 2005/0233342 A1 | 10/2005 | Manoharan et al. |
| 2005/0255487 A1 | 11/2005 | Khvorova et al. |
| 2005/0260620 A1 | 11/2005 | Christiano et al. |
| 2006/0069056 A1 | 3/2006 | Feinstein et al. |
| 2006/0217329 A1 | 9/2006 | Feinstein et al. |
| 2007/0031844 A1 | 2/2007 | Khvorova et al. |
| 2007/0032441 A1 | 2/2007 | McSwiggen et al. |
| 2007/0042982 A1 | 2/2007 | Bentwich |
| 2007/0243242 A1* | 10/2007 | Smith ........................... 424/450 |
| 2008/0020007 A1 | 1/2008 | Zang |
| 2008/0064650 A1 | 3/2008 | Feinstein et al. |
| 2008/0108583 A1 | 5/2008 | Feinstein |
| 2008/0311051 A1 | 12/2008 | Chauvier et al. |
| 2009/0105173 A1 | 4/2009 | Feinstein |

(Continued)

FOREIGN PATENT DOCUMENTS

| | | |
|---|---|---|
| WO | WO 00/44914 | 8/2000 |
| WO | WO 01/68836 | 9/2001 |

(Continued)

OTHER PUBLICATIONS

Written Opinion of the International Searching Authority (ISA/US) issued on Nov. 25, 2009 in connection with PCT International Application No. PCT/IL2009/000570.
International Preliminary Report on Patentability issued by the International Searching Authority (ISA/US) on Dec. 16, 2010 in connection with PCT International Application No. PCT/IL2009/000570.
Amarzguioui et al., Tolerance for mutations and chemical modifications in a siRNA, Nucleic Acids Research, (2003), 31(2):589-595.
Barik, Silence of the transcripts: RNA interference in medicine. J. Mol. Med (2005) 83: 764-773.
Bass, Double-Stranded RNA as a Template for Gene Silencing, Cell, (2000), 101:235-238.
Bernstein, et al., The rest is silence. RNA. (2001), 7(11):1509-21.
Braasch RNA interference in mammalian cells by chemically-modified RNA (2003). Biochem., 42(26):7967-75.

(Continued)

Primary Examiner — Amy Bowman
(74) Attorney, Agent, or Firm — John P. White; Cooper & Dunham LLP

(57) ABSTRACT

The present invention relates to pharmaceutical compositions useful for topical, non-invasive delivery of an oligonucleotide to the ear and to methods for the treatment of an ear disorder, including hearing loss arising from chemical-induced ototoxicity, acoustic trauma and presbycusis; and microbial infections. The method comprises topically administering to the ear of a subject in need thereof a pharmaceutical composition comprising an inhibitory oligonucleotide, a permeability enhancer and a pharmaceutically acceptable carrier, wherein the oligonucleotide reduces or inhibits expression of a gene associated with the ear disorder in the subject.

18 Claims, 49 Drawing Sheets

U.S. PATENT DOCUMENTS

| | | | |
|---|---|---|---|
| 2009/0162365 | A1 | 6/2009 | Feinstein et al. |
| 2009/0192104 | A1 | 7/2009 | Mcswiggen et al. |
| 2009/0263323 | A1 | 10/2009 | Krause et al. |
| 2010/0029746 | A1 | 2/2010 | Feinstein |
| 2010/0272722 | A1 | 10/2010 | Feinstein et al. |
| 2010/0292301 | A1 | 11/2010 | Feinstein et al. |
| 2011/0112168 | A1 | 5/2011 | Feinstein et al. |
| 2011/0229557 | A1 | 9/2011 | Feinstein et al. |
| 2011/0251260 | A1* | 10/2011 | Feinstein et al. ............ 514/44 A |

FOREIGN PATENT DOCUMENTS

| | | |
|---|---|---|
| WO | WO 02/024720 | 3/2002 |
| WO | WO 02/055693 | 7/2002 |
| WO | WO 03/064621 | 8/2003 |
| WO | WO 03/070918 | 8/2003 |
| WO | WO 03/074654 | 9/2003 |
| WO | WO 2004/103389 | 12/2004 |
| WO | WO 2005/055921 | 6/2005 |
| WO | WO 2005/119251 | 12/2005 |
| WO | WO 2007/014075 | 2/2007 |
| WO | WO 2007/084684 | 7/2007 |
| WO | WO 2007/087451 | 8/2007 |
| WO | WO 2008/050329 | 5/2008 |
| WO | WO 2008/104978 | 9/2008 |
| WO | WO 2009/044392 | 4/2009 |

OTHER PUBLICATIONS

Breuskin et al., Strategies to regenerate hair cells:Identification of progenitors and critical genes. Hearing Research 2008 236:1-10.

Caplen et al., Specific inhibition of gene expression by small double-stranded RNAs in invertebrate and vertebrate systems. PNAS (2001), 98:9742-974.

Chakraborty, Potentiality of small interfering RNAs (siRNA) as recent therapeutic targets for gene-silencing. Current Drug Targets (2007) 8(3):469-82).

Chalk et al., Improved and automated prediction of effective siRNA. BBRC. (2004). 319(1): 264-274.

Chiu et al., siRNA function in RNAi: a chemical modification analysis. RNA, (2003) 9(9):1034-48.

Czauderna, et al., Structural variations and stabilising modifications of synthetic siRNAs in mammalian cells, Nucleic Acids Res., (2003), 31(11):2705-2716.

Dykxhoorn et al., The silent treatment: siRNAs as small molecule drugs Gene Ther. (2006). 13:541-552.

Elhashir et al., Duplexes of 21-nucleotide RNAs mediate RNA interference in cultured mammalian cells. Nature (2001), 411:494-498.

Elbashir, et al., Functional anatomy of siRNAs for mediating efficient RNAi in *Drosophila melanogaster* embryo lysate, EMBO J., (2001), 20:6877-6888.

Elbashir, et al., RNA interference is mediated by 21- and 22-nucleotide RNAs, Genes Dev., (2001), 15:188-200.

Fire, et al., Potent and specific genetic interference by double-stranded RNA in *Caenorhabditis elegans*, Nature, (1998), 391:806-811.

Levenkova et al., Gene specific siRNA selector, Bioinform. (2004), 20(3):430-432.

Mahato et al., "Modulation of Gene Expression by Antisense and Antigene Oligodeoxynucleotides and Small Interfering RNA." Expert Opinion on Drug Delivery (2005), 2(1):3-28.

McManus, et al., Gene silencing using micro-RNA designed hairpins, RNA, (2002), 8:842-850.

McManus and Sharp, Gene silencing in mammals by small interfering RNAs. Nature Rev Genet, (2002), 3:737-47.

Paddison et al., siRNAs and shRNAs: skeleton keys to the human genome. Curr Opin Mol Ther. (2003), 5(3): 217-224.

Prakash et al., Positional Effect of Chemical Modifications on Short Interference RNA Activity in Mammalian Cells, J. Med. Chem., (2005), 48:4247-4253.

Sharp, RNAi and double-strand RNA, Genes & Dev., (1999), 13:139-141.

Scherer et al., Therapeutic Applications of RNA Interference: Recent Advances in siRNA Design. Advances in Genetics, (2004), vol. 52, 1-21.

Ui-Tei et al., Guidelines for the selection of highly effective siRNA sequences for mammalian and chick RNA interference. NAR (2004), 32(3):936-948.

Ui-Tei et al., Essential notes regarding the design of functional siRNAs for efficient mammalian RNAi. J Biomed Biotechnol (2006), 2006:65052.

Wang et al., A peptide inhibitor of c-Jun N-terminal kinase protects against both aminoglycoside and acoustic trauma-induced auditory hair cell death and hearing loss. J. Neuroscience (2003), 23(24):8596-8607.

Zamore, et al., RNAi: Double-Stranded RNA Directs the ATP-Dependent Cleavage of mRNA at 21 to 23 Nucleotide Intervals, Cell, (2000), 101:25-33.

Zhang et al., Pifithrin-alpha suppresses p53 and protects cochlear and vestibular hair cells from cisplatin-induced apoptosis. Neuroscience (2003), 120:191-205.

International Search Report issued by the International Searching Authority (ISA/US) on Nov. 25, 2009 in connection with International Application No. PCT/AU2009/000570.

Written Opinion of the International Searching Authority issued on Nov. 2, 2010 in connection with International Application No. PCT/IL2009/000570.

Chiu and Rana, (2002) "RNAi in Human Cells: basic Structural and Function Features of Small Interfering RNA". Molecular Cell, 19:549-561.

Maeda et al., (2009) "Therapeutic regulation of gene expression in the inner ear using RNA interference" Adv Otorhinolaryngol, 66:13-36.

Seidman et al., (2003) "Pharmacologic manipulation of the labyrinth with novel and traditional agents delivered to the inner ear" ENT—Ear Nose Throat J., April pp. 276-300.

Swan et al., (2008) "Inner Ear Drug Delivery for Auditory Applications" Adv Drug Deliv Rev., 60(15):1583-1599.

Final Office Action issued Mar. 14, 2011 in respect of U.S. Appl. No. 11/978,089 (US 2009/0162365).

Amendment filed Jan. 19, 2012 in response to Final Office Action issued Mar. 14, 2012 in respect of U.S. Appl. No. 11/978,089 (US 2009/0162365).

Extended European Search Report and Opinion issued Jan. 9, 2011 in respect of EP 11170912.7 (Divisional application of EPO National Phase application of PCT/IL2007/001278).

Supplementary European Search Report and Opinion issued Dec. 6, 2011 in respect of EP 08808012.2 (EPO National Phase application of PCT/IL2008/001197).

Wang et al., (2005) "Endotoxemic Acute Renal Failure is Attenuated in Caspase-1-Deficient Mice" Am J Physiol Renal Physiology, 288:F997-F1004.

* cited by examiner 3 days termination 3 days after inoculation

FIGURE 4

Table A1: HES1 - hairy and enhancer of split 1

| No. | SEQ ID NO. | Sense siRNA | SEQ ID NO. | AntiSense siRNA | Other Sp | Human-8400709 ORF:237-1079 |
|---|---|---|---|---|---|---|
| 1 | 37 | GCGCCUUUGUAUUAUAAAA | 449 | UUUUAUAAUACAAAGGCGC | Rat,Ms | [1301-1319] 3'UTR |
| 2 | 38 | CAAGUAAAAGAGACACAAA | 450 | UUUGUGUCUCUUUUACUUG | | [147-165] 5'UTR |
| 3 | 39 | CUCUAAACAGGAACUUGAA | 451 | UUCAAGUUCCUGUUUAGAG | | [1137-1155] 3'UTR |
| 4 | 40 | GGUGCUGAUAACAGCGGAA | 452 | UUCCGCUGUUAUCAGCACC | Ms | [21-39] 5'UTR |
| 5 | 41 | UGCCAAAGAUGUUUGAAAA | 453 | UUUUCAAACAUCUUUGGCA | Rat,Ms | [1367-1385] 3'UTR |
| 6 | 42 | CUUGAAUACUGGGAGAGAA | 454 | UUCUCUCCCAGUAUUCAAG | | [1150-1168] 3'UTR |
| 7 | 43 | GUAAAAGAGACACAAACAA | 455 | UUGUUUGUGUCUCUUUUAC | | [150-168] 5'UTR |
| 8 | 44 | CGUGAAGAACUCCAAAAAU | 456 | AUUUUUGGAGUUCUUCACG | | [181-199] 5'UTR |
| 9 | 45 | GAACUUGAAUACUGGGAGA | 457 | UCUCCCAGUAUUCAAGUUC | | [1147-1165] 3'UTR |
| 10 | 46 | GGACAUUCUGGAAAUGACA | 458 | UGUCAUUCCAGAAUGUCC | | [470-488] ORF |
| 11 | 47 | GGAGAAAAGACGAAGAGCA | 459 | UGCUCUUCGUCUUUUCUCC | GP | [362-380] ORF |
| 12 | 48 | CAGCAUCUGAGCACAGAAA | 460 | UUUCUGUGCUCAGAUGCUG | | [325-343] ORF |
| 13 | 49 | AGAAAGUCAUCAAAGCCUA | 461 | UAGGCUUUGAUGACUUUCU | Rat,Ms,GP,Chn | [339-357] ORF |
| 14 | 50 | AGCACAGAAAGUCAUCAAA | 462 | UUUGAUGACUUUCUGUGCU | Rat,Ms,Chn | [334-352] ORF |
| 15 | 51 | CUUCCCUCCGGACUCUAAA | 463 | UUUAGAGUCCGGAGGGAAG | | [1125-1143] 3'UTR |
| 16 | 52 | GAGAGAAGAGGACUUUUUU | 464 | AAAAAAGUCCUCUUCUCUC | | [1162-1180] 3'UTR |
| 17 | 53 | UCACCAAGUAGCCACAAAA | 465 | UUUUGUGGCUACUUGGUGA | | [84-102] 5'UTR |
| 18 | 54 | GCCUAUUAUGGAGAAAAGA | 466 | UCUUUUCUCCAUAAUAGGC | | [353-371] ORF |
| 19 | 55 | GGCAUUCCAAGCUGGAGAA | 467 | UUCUCCAGCUUGGAAUGCC | Rat,GP,Chn | [448-466] ORF |
| 20 | 56 | UGAAAACACUGAUUUUGGA | 468 | UCCAAAAUCAGUGUUUUCA | Rat,Ms,GP,Chn | [406-424] ORF |
| 21 | 57 | UCGUGAAGAACUCCAAAAA | 469 | UUUUUGGAGUUCUUCACGA | | [180-198] 5'UTR |
| 22 | 58 | CUUUUUUAUGUGAUGCUAA | 470 | UUGGCAUCACAUAAAAAAG | | [1354-1372] 3'UTR |
| 23 | 59 | GUUACUUUUGUAGAGAGA | 471 | UCUCUCUACAAAAAGUAAC | | [1220-1238] 3'UTR |
| 24 | 60 | AGUCUGAGCCAGCUGAAAA | 472 | UUUUCAGCUGGCUCAGACU | | [393-411] ORF |
| 25 | 61 | CCAGCUGAUAUAAUGGAGA | 473 | UCUCCAUUAUAUCAGCUGG | Rat,Ms,Chn | [240-258] ORF |
| 26 | 62 | GGGAGAGAAGAGGACUUUU | 474 | AAAAGUCCUCUUCUCUCCC | | [1160-1178] 3'UTR |
| 27 | 63 | ACUGCAUGACCCAGAUCAA | 475 | UUGAUCUGGGUCAUGCAGU | Rat,Ms,GP,Chn | [670-688] ORF |
| 28 | 64 | GCUGAUAUAAUGGAGAAAA | 476 | UUUUCUCCAUUAUAUCAGC | Rat,Ms,Chn | [243-261] ORF |
| 29 | 65 | UUGCUUUCCUCAUUCCCAA | 477 | UUGGGAAUGAGGAAAGCAA | | [922-940] ORF |
| 30 | 66 | UGAUUUUGGAUGCUCUGAA | 478 | UUCAGAGCAUCCAAAAUCA | | [415-433] ORF |
| 31 | 67 | UCAAGUAAAAGAGACACAA | 479 | UUGUGUCUCUUUUACUUGA | | [146-164] 5'UTR |
| 32 | 68 | GGAUGCUCUGAAGAAAGAU | 480 | AUCUUUCUUCAGAGCAUCC | | [422-440] ORF |
| 33 | 69 | CUGGAACAGCGCUACUGAU | 481 | AUCAGUAGCGCUGUUCCAG | | [66-84] 5'UTR |
| 34 | 70 | GGAUAAACCAAAGCAGCA | 482 | UGCUGCUUUGGUUUAUCC | | [311-329] ORF |
| 35 | 71 | GGAGCUGGUGCUGAUAACA | 483 | UGUUAUCAGCACCAGCUCC | | [15-33] 5'UTR |
| 36 | 72 | UGCUCAGUAGUUUUGUGAA | 484 | UUCACAAAACUACUGAGCA | | [123-141] 5'UTR |
| 37 | 73 | AGAAGAGGACUUUUUUGAU | 485 | AUCAAAAAAGUCCUCUUCU | | [1165-1183] 3'UTR |
| 38 | 74 | GGAGAAGAGGACUUUUU | 486 | AAAAAGUCCUCUUCUCUCC | | [1161-1179] 3'UTR |
| 39 | 75 | UUUGGAUGCUCUGAAGAAA | 487 | UUUCUUCAGAGCAUCCAAA | | [419-437] ORF |
| 40 | 76 | AGUAAAAGAGACACAAACA | 488 | UGUUUGUGUCUCUUUUACU | | [149-167] 5'UTR |
| 41 | 77 | UGCGCCUUUGUAUUAUAAA | 489 | UUUAUAAUACAAAGGCGCA | Rat,Ms | [1300-1318] 3'UTR |
| 42 | 78 | GCCAGUUUGCUUUCCUCAU | 490 | AUGAGGAAAGCAAACUGGC | | [916-934] ORF |
| 43 | 79 | UUCUGGAAAUGACAGUGAA | 491 | UUCACUGUCAUUUCCAGAA | Rat | [475-493] ORF |
| 44 | 80 | CACUGAUUUUGGAUGCUCU | 492 | AGAGCAUCCAAAAUCAGUG | | [412-430] ORF |
| 45 | 81 | GUAUUAAGUGACUGACCAU | 493 | AUGGUCAGUCACUUAAUAC | Rat,Ms,GP | [1242-1260] 3'UTR |
| 46 | 82 | GAUUUUGGAUGCUCUGAAG | 494 | CUUCAGAGCAUCCAAAAUC | | [416-434] ORF |
| 47 | 83 | GCAUCUGAGCACAGAAAGU | 495 | ACUUUCUGUGCUCAGAUGC | | [327-345] ORF |
| 48 | 84 | ACAGCAUCUGAGCACAGAA | 496 | UUCUGUGCUCAGAUGCUGU | | [324-342] ORF |
| 49 | 85 | AGCUGAUAUAAUGGAGAAA | 497 | UUUCUCCAUUAUAUCAGCU | Rat,Ms,Chn | [242-260] ORF |
| 50 | 86 | GUGAAGAACUCCAAAAAUA | 498 | UAUUUUUGGAGUUCUUCAC | | [182-200] 5'UTR |
| 51 | 87 | UUUCGUGAAGAACUCCAAA | 499 | UUUGGAGUUCUUCACGAAA | | [178-196] 5'UTR |
| 52 | 88 | AGAUCAAUGCCAUGACCUA | 500 | UAGGUCAUGGCAUUGAUCU | | [682-700] ORF |
| 53 | 89 | AUAGCUCGCGGCAUUCCAA | 501 | UUGGAAUGCCGCGAGCUAU | | [439-457] ORF |
| 54 | 90 | CGCUACUGAUCACCAAGUA | 502 | UACUUGGUGAUCAGUAGCG | | [75-93] 5'UTR |
| 55 | 91 | GAAAGUCUGAGCCAGCUGA | 503 | UCAGCUGGCUCAGACUUUC | | [390-408] ORF |
| 56 | 92 | ACCAAGUAGCCACAAAAUA | 504 | UAUUUUGUGGCUACUUGGU | | [86-104] 5'UTR |
| 57 | 93 | UGGAAAUGACAGUGAAGCA | 505 | UGCUUCACUGUCAUUUCCA | Rat | [478-496] ORF |
| 58 | 94 | AAAGUCUGAGCCAGCUGAA | 506 | UUCAGCUGGCUCAGACUUU | | [391-409] ORF |
| 59 | 95 | AAAAGACGAAGAGCAAGAA | 507 | UUCUUGCUCUUCGUCUUUU | | [366-384] ORF |
| 60 | 96 | GAGAAGAGGACUUUUUUGA | 508 | UCAAAAAAGUCCUCUUCUC | | [1164-1182] 3'UTR |

FIGURE 4 Continued

| | | | | | | |
|---|---|---|---|---|---|---|
| 61 | 97 | UGGUGCUGAUAACAGCGGA | 509 | UCCGCUGUUAUCAGCACCA | Ms | [20-38] 5'UTR |
| 62 | 98 | CCAUGCACUAUAUUUGUAU | 510 | AUACAAAUAUAGUGCAUGG | | [1257-1275] 3'UTR |
| 63 | 99 | AGCUGAAAACACUGAUUUU | 511 | AAAAUCAGUGUUUUCAGCU | GP,Chn | [403-421] ORF |
| 64 | 100 | UGAUGCCAAAGAUGUUUGA | 512 | UCAAACAUCUUUGGCAUCA | Rat,Ms | [1364-1382] 3'UTR |
| 65 | 101 | UUUUGUAGAGAGAGCUGUA | 513 | UACAGCUCUCUCUACAAAA | | [1226-1244] 3'UTR |
| 66 | 102 | GAAAGAUAGCUCGCGGCAU | 514 | AUGCCGCGAGCUAUCUUUC | | [434-452] ORF |
| 67 | 103 | AGCUGUAUUAAGUGACUGA | 515 | UCAGUCACUUAAUACAGCU | Rat,Ms,GP | [1238-1256] 3'UTR |
| 68 | 104 | CGGACAUUCUGGAAAUGCC | 516 | GUCAUUUCCAGAAAUGUCCG | | [469-487] ORF |
| 69 | 105 | AAGUCAUCAAAGCCUAUUA | 517 | UAAUAGGCUUUGAUGACUU | | [342-360] ORF |
| 70 | 106 | AGUUUUGUGAAAGUCUCAA | 518 | UUGAGACUUUCACAAAACU | | [131-149] 5'UTR |
| 71 | 107 | AUGCCAAAGAUGUUUGAAA | 519 | UUUCAAACAUCUUUGGCAU | Rat,Ms | [1366-1384] 3'UTR |
| 72 | 108 | UGUAUUAAGUGACUGACCA | 520 | UGGUCAGUCACUUAAUACA | Rat,Ms,GP | [1241-1259] 3'UTR |
| 73 | 109 | GAAGAGGACUUUUUUGAUU | 521 | AAUCAAAAAAGUCCUCUUC | | [1166-1184] 3'UTR |
| 74 | 110 | UCCGGACUCUAAACAGGAA | 522 | UUCCUGUUUAGAGUCCGGA | | [1131-1149] 3'UTR |
| 75 | 111 | CACCAAGUAGCCACAAAAU | 523 | AUUUUGUGGCUACUUGGUG | | [85-103] 5'UTR |
| 76 | 112 | CUGCAUGACCCAGAUCAAU | 524 | AUUGAUCUGGGUCAUGCAG | | [671-689] ORF |
| 77 | 113 | UAUGGAGAAAAGACGAAGA | 525 | UCUUCGUCUUUUCUCCAUA | | [359-377] ORF |
| 78 | 114 | UAUUAUGGAGAAAAGACGA | 526 | UCGUCUUUUCUCCAUAAUA | | [356-374] ORF |
| 79 | 115 | AUUGGAUUGCGCCUUUGUA | 527 | UACAAAGGCGCAAUCCAAU | Rat,Ms | [1293-1311] 3'UTR |
| 80 | 116 | GGACUUUUUUGAUUAAGUG | 528 | CACUUAAUCAAAAAAGUCC | | [1171-1189] 3'UTR |
| 81 | 117 | UCUUCCUCCGGACUCUAA | 529 | UUAGAGUCCGGAGGGAAGA | | [1124-1142] 3'UTR |
| 82 | 118 | AGCCUAUUAUGGAGAAAAG | 530 | CUUUUCUCCAUAAUAGGCU | | [352-370] ORF |
| 83 | 119 | AGAGCUGUAUUAAGUGACU | 531 | AGUCACUUAAUACAGCUCU | Rat,Ms,GP | [1236-1254] 3'UTR |
| 84 | 120 | UUUUGGAUGCUCUGAAGAA | 532 | UUCUUCAGAGCAUCCAAAA | | [418-436] ORF |
| 85 | 121 | AAGUCAGCUGGCUCAGAAA | 533 | UUUCUGAGCCAGCUGACUU | | [392-410] ORF |
| 86 | 122 | ACGACACCGGAUAAACCAA | 534 | UUGGUUUAUCCGGUGUCGU | | [303-321] ORF |
| 87 | 123 | AAAUGCCAGCUGAUAUAAU | 535 | AUUAUAUCAGCUGGCAUUU | Rat,Ms,Chn | [235-253] 5'UTR+ORF |
| 88 | 124 | AUUGCGCCUUUGUAUUAUAU | 536 | UAUAAUACAAAGGCGCAAU | Rat,Ms | [1298-1316] 3'UTR |
| 89 | 125 | UGAAUACUGGGAGAGAAGA | 537 | UCUUCUCUCCCAGUAUUCA | | [1152-1170] 3'UTR |
| 90 | 126 | ACUUGAAUACUGGGAGAGA | 538 | UCUCUCCCAGUAUUCAAGU | | [1149-1167] 3'UTR |
| 91 | 127 | AAAGCCUAUUAUGGAGAAA | 539 | UUUCUCCAUAAUAGGCUUU | | [350-368] ORF |
| 92 | 128 | UAGUUUUGUGAAAGUCUCA | 540 | UGAGACUUUCACAAAACUA | | [130-148] 5'UTR |
| 93 | 129 | GAUGUUUGAAAAUGCUCUU | 541 | AAGAGCAUUUUCAAACAUC | Ms | [1374-1392] 3'UTR |
| 94 | 130 | GUGGUUACUUUGUGUUUUU | 542 | AAAAACACAAAGUAACCAC | | [1187-1205] 3'UTR |
| 95 | 131 | CUGGGAGAAGAAGGACUU | 543 | AAGUCCUCUUCUCUCCCAG | | [1158-1176] 3'UTR |
| 96 | 132 | ACGUGCGAGGGCGUUAAUA | 544 | UAUUAACGCCCUCGCACGU | | [615-633] ORF |
| 97 | 133 | AGUCAUCAAAGCCUAUUAU | 545 | AUAAUAGGCUUUGAUGACU | | [343-361] ORF |
| 98 | 134 | AAGGCGGACAUUCUGGAAA | 546 | UUUCCAGAAUGUCCGCCUU | | [465-483] ORF |
| 99 | 135 | AAGCCUAUUAUGGAGAAAA | 547 | UUUUCUCCAUAAUAGGCUU | | [351-369] ORF |
| 100 | 136 | CUCAGAUGACAUUUCGUUU | 548 | AAACGAAAUGUCAUCUGAG | | [1321-1339] 3'UTR |
| 101 | 137 | GCCAAAGAUGUUUGAAAAU | 549 | AUUUUCAAACAUCUUUGGC | Ms | [1368-1386] 3'UTR |
| 102 | 138 | CCUCAGCACUUGCUCAGUA | 550 | UACUGAGCAAGUGCUGAGG | | [113-131] 5'UTR |
| 103 | 139 | UAGAGAGCUGUAUUAAG | 551 | CUUAAUACAGCUCUCUCUA | | [1231-1249] 3'UTR |
| 104 | 140 | UCUAAACAGGAACUUGAAU | 552 | AUUCAAGUUCCUGUUUAGA | | [1138-1156] 3'UTR |
| 105 | 141 | CGGACUCUAAACAGGAACU | 553 | AGUUCCUGUUUAGAGUCCG | | [1133-1151] 3'UTR |
| 106 | 142 | UCUCCUUGGUCCUGGAACA | 554 | UGUUCCAGGACCAAGGAGA | | [55-73] 5'UTR |
| 107 | 143 | CAAAGAUGUUUGAAAAUGC | 555 | GCAUUUUCAAACAUCUUUG | Ms | [1370-1388] 3'UTR |
| 108 | 144 | UUUCGUUUUUUACACGAGA | 556 | UCUCGUGUAAAAAACGAAA | Rat,Ms | [1332-1350] 3'UTR |
| 109 | 145 | AGUGACUGACCAUGCACUA | 557 | UAGUGCAUGGUCAGUCACU | GP | [1248-1266] 3'UTR |
| 110 | 146 | GGAACUUGAAUACUGGGAG | 558 | CUCCCAGUAUUCAAGUUCC | | [1146-1164] 3'UTR |
| 111 | 147 | GCUUCAGCGAGUGCAUGAA | 559 | UUCAUGCACUCGCUGAAGC | Rat,Ms,GP,Chn | [574-592] ORF |
| 112 | 148 | GCGGACAUUCUGGAAAUGA | 560 | UCAUUUCCAGAAUGUCCGC | | [468-486] ORF |
| 113 | 149 | GAAAACACUGAUUUUGGAU | 561 | AUCCAAAAUCAGUGUUUUC | Rat,Ms,GP,Chn | [407-425] ORF |
| 114 | 150 | AAAGACGAAGAGCAAGAAU | 562 | AUUCUUGCUCUUCGUCUUU | | [367-385] ORF |
| 115 | 151 | CAGAUGACAUUUCGUUUUG | 563 | AAAAACGAAAUGUCAUCUG | | [1323-1341] 3'UTR |
| 116 | 152 | AGCUCAGAUGACAUUUCGU | 564 | ACGAAAUGUCAUCUGAGCU | | [1319-1337] 3'UTR |
| 117 | 153 | GAAUACUGGGAGAGAAGAG | 565 | CUCUUCUCUCCCAGUAUUC | | [1153-1171] 3'UTR |
| 118 | 154 | ACAGGAACUUGAAUACUGG | 566 | CCAGUAUUCAAGUUCCUGU | | [1143-1161] 3'UTR |
| 119 | 155 | GGCCAGUUUGCUUUCCUCA | 567 | UGAGGAAAGCAAACUGGCC | | [915-933] ORF |
| 120 | 156 | UGAUCACCAAGUAGCCACA | 568 | UGUGGCUACUUGGUGAUCA | | [81-99] 5'UTR |
| 121 | 157 | AAGACAGCAUCUGAGCACA | 569 | UGUGCUCAGAUGCUGUCUU | | [321-339] ORF |
| 122 | 158 | ACCGGAUAAACCAAAGACA | 570 | UGUCUUUGGUUUAUCCGGU | | [308-326] ORF |
| 123 | 159 | GCCAGCUGAUAUAAUGGAG | 571 | CUCCAUUAUAUCAGCUGGC | Rat,Ms,Chn | [239-257] ORF |
| 124 | 160 | AAAAUGCCAGCUGAUAUAA | 572 | UUAUAUCAGCUGGCAUUUU | Rat,Ms,Chn | [234-252] 5'UTR+ORF |
| 125 | 161 | AAGUCUCAAGUAAAAGAGA | 573 | UCUCUUUUACUUGAGACUU | | [141-159] 5'UTR |
| 126 | 162 | AACGCAGUGUCACCUUCCA | 574 | UGGAAGGUGACACUGCGUU | Ms | [1011-1029] ORF |
| 127 | 163 | GACCCAGAUCAAUGCCAUG | 575 | CAUGGCAUUGAUCUGGGUC | | [677-695] ORF |
| 128 | 164 | GAGUGCAUGAACGAGGUGA | 576 | UCACCUCGUUCAUGCACUC | Rat,Ms,GP,Chn | [582-600] ORF |

FIGURE 4 Continued

| | | | | | | | |
|---|---|---|---|---|---|---|---|
| 129 | 165 | AGAAGGCGGACAUUCUGGA | 577 | UCCAGAAUGUCCGCCUUCU | | [463-481] ORF |
| 130 | 166 | AGAAAGAUAGCUCGCGGCA | 578 | UGCCGCGAGCUAUCUUUCU | | [433-451] ORF |
| 131 | 167 | GACAGCAUCUGAGCACAGA | 579 | UCUGUGCUCAGAUGCUGUC | | [323-341] ORF |
| 132 | 168 | CCGGAUAAACCAAAGACAG | 580 | CUGUCUUUGGUUUAUCCGG | Chn | [309-327] ORF |
| 133 | 169 | CACGACACCGGAUAAACCA | 581 | UGGUUUAUCCGGUGUCGUG | Chn | [302-320] ORF |
| 134 | 170 | GCACUUGCUCAGUAGUUUU | 582 | AAAACUACUGAGCAAGUGC | | [118-136] 5'UTR |
| 135 | 171 | AGAUGUUUGAAAAUGCUCU | 583 | AGAGCAUUUUCAAACAUCU | Ms | [1373-1391] 3'UTR |
| 136 | 172 | AUAAAAGCUCAGAUGCACAU | 584 | AUGUCAUCUGAGCUUUUAU | | [1314-1332] 3'UTR |
| 137 | 173 | GAAGUUACUUUUUGUAGAG | 585 | CUCUACAAAAAGUAACUUC | | [1217-1235] 3'UTR |
| 138 | 174 | CUCCGGACUCUAAACAGGA | 586 | UCCUGUUUAGAGUCCGGAG | | [1130-1148] 3'UTR |
| 139 | 175 | GCGCUACUGAUCACCAAGU | 587 | ACUUGGUGAUCAGUAGCGC | | [74-92] 5'UTR |
| 140 | 176 | CCAGCUGAAAACACUGAUU | 588 | AAUCAGUGUUUUCAGCUGG | GP,Chn | [401-419] ORF |
| 141 | 177 | AUUAUGGAGAAAAGACGAA | 589 | UUCGUCUUUUCUCCAUAAU | | [357-375] ORF |
| 142 | 178 | CAAAGACAGCAUCUGAGCA | 590 | UGCUCAGAUGCUGUCUUUG | | [319-337] ORF |
| 143 | 179 | GUCUCAAGUAAAAGAGACA | 591 | UGUCUCUUUUACUUGAGAC | | [143-161] 5'UTR |
| 144 | 180 | UCAGUAGUUUUGUGAAAGU | 592 | ACUUUCACAAAACUACUGA | | [126-144] 5'UTR |
| 145 | 181 | GUGACUGACCAUGCACUAU | 593 | AUAGUGCAUGGUCAGUCAC | GP | [1249-1267] 3'UTR |
| 146 | 182 | UGACCCAGAUCAAUGCCAU | 594 | AUGGCAUUGAUCUGGGUCA | | [676-694] ORF |
| 147 | 183 | GAAGAAAGAUAGCUCGCGG | 595 | CCGCGAGCUAUCUUUCUUC | | [431-449] ORF |
| 148 | 184 | ACACCGGAUAAACCAAAGA | 596 | UCUUUGGUUUAUCCGGUGU | Chn | [306-324] ORF |
| 149 | 185 | UUUUCGUGAAGAACUCCAA | 597 | UUGGAGUUCUUCACGAAAA | | [177-195] 5'UTR |
| 150 | 186 | AAGUAAAAGAGACACAAAC | 598 | GUUUGUGUCUCUUUUACUU | | [148-168] 5'UTR |
| 151 | 187 | CGCCUUUGUAUUAUAAAG | 599 | CUUUUAUAAUACAAAGGCG | Rat,Ms | [1302-1320] 3'UTR |
| 152 | 188 | AUAUAAUAAACCCUCAGCA | 600 | UGCUGAGGGUUUAUUAUAU | | [102-120] 5'UTR |
| 153 | 189 | AUACGGGAGAGAAGGAGGA | 601 | UCCUCUUCUCUCCCAGUAU | | [1155-1173] 3'UTR |
| 154 | 190 | GGCGGACAUUCUGGAAAUG | 602 | CAUUUCCAGAAUGUCCGCC | | [467-485] ORF |
| 155 | 191 | UGGAGAAGGCGGACAUUCU | 603 | AGAAUGUCCGCCUUCUCCA | | [460-478] ORF |
| 156 | 192 | AGUAGUUUUGUGAAAGUCU | 604 | AGACUUUCACAAAACUACU | | [128-146] 5'UTR |
| 157 | 193 | GAUGCCAAAGAUGUUUGAA | 605 | UUCAAACAUCUUUGGCAUC | Rat,Ms | [1365-1383] 3'UTR |
| 158 | 194 | AUGUGAUGCCAAAGAUGUU | 606 | AACAUCUUUGGCAUCACAU | Rat,Ms | [1361-1379] 3'UTR |
| 159 | 195 | UUGGAUUGCGCCUUUGUAU | 607 | AUACAAAGGCGCAAUCCAA | Rat,Ms | [1294-1312] 3'UTR |
| 160 | 196 | UCAGCGAGUGCAUGAACGA | 608 | UCGUUCAUGCACUCGCUGA | Rat,Ms,GP,Chn | [577-595] ORF |
| 161 | 197 | CCUAUUAUGGAGAAAAGAC | 609 | GUCUUUUCUCCAUAAUAGG | | [354-372] ORF |
| 162 | 198 | AGCCAGUGUCAACACGACA | 610 | UGUCGUGUUGACACUGGCU | Rat,Ms | [290-308] ORF |
| 163 | 199 | GUAGUUUUGUGAAAGUCUA | 611 | GAGACUUUCACAAAACUAC | | [129-147] 5'UTR |
| 164 | 200 | CUAAGGUGUUUGGAGGCUU | 612 | AAGCCUCCAAACACCUUAG | | [874-892] ORF |
| 165 | 201 | AGUGCAUGAACGAGGUGAC | 613 | GUCACCUCGUUCAUGCACU | Rat,Ms,GP,Chn | [583-601] ORF |
| 166 | 202 | AAAUGACAGUGAAGCACCU | 614 | AGGUGCUUCACUGUCAUUU | Rat | [481-499] ORF |
| 167 | 203 | AGAAAGACGAAGAGCAAG | 615 | CUUGCUCUUCGUCUUUUCU | GP | [364-382] ORF |
| 168 | 204 | UUCGUGAAGAACUCCAAAA | 616 | UUUUGGAGUUCUUCACGAA | | [179-197] 5'UTR |
| 169 | 205 | UCUUUUUUAUGUGAUGCCA | 617 | UGGCAUCACAUAAAAAAGA | | [1353-1371] 3'UTR |
| 170 | 206 | CUGACCAUGCACUAUAUUU | 618 | AAAUAUAGUGCAUGGUCAG | GP | [1253-1271] 3'UTR |
| 171 | 207 | AGUGGUUACUUUGUGUUUU | 619 | AAAACACAAAGUAACCACU | | [1186-1204] 3'UTR |
| 172 | 208 | AGAGAAGAGGACUUUUUCU | 620 | CAAAAAGUCCUCUUCUCU | | [1163-1181] 3'UTR |
| 173 | 209 | AGGUGUUUGGAGGCUUCCA | 621 | UGGAAGCCUCCAAACACCU | | [877-895] ORF |
| 174 | 210 | UGAGCCAGCUGAAAACACU | 622 | AGUGUUUUCAGCUGGCUCA | Chn | [397-415] ORF |
| 175 | 211 | CAGAAAGUCAUCAAAGCCU | 623 | AGGCUUUGAUGACUUUCUG | Rat,Ms,GP,Chn | [338-356] ORF |
| 176 | 212 | GCUCUUAAAAUAUCUUCCU | 624 | AGGAAGAUAUUUUAAGAGC | Rat,Ms | [1387-1405] 3'UTR |
| 177 | 213 | GUUAAUACCGAGGUGCGCA | 625 | UGCGCACCUCGGUAUUAAC | | [627-645] ORF |
| 178 | 214 | CUGAUUUUGGAUGCUCUGA | 626 | UCAGAGCAUCCAAAAUCAG | | [414-432] ORF |
| 179 | 215 | GUCUGAGCCAGCUGAAAAC | 627 | GUUUUCAGCUGGCUCAGAC | | [394-412] ORF |
| 180 | 216 | UGCCAGCUGAUAUAAUGGA | 628 | UCCAUUAUAUCAGCUGGCA | Rat,Ms,Chn | [238-256] ORF |
| 181 | 217 | AAGUGGUUACUUUGUGUUU | 629 | AAACACAAAGUAACCACUU | | [1185-1203] 3'UTR |
| 182 | 218 | CAGGAACUUGAAUACUGGG | 630 | CCCAGUAUUCAAGUUCCUG | | [1144-1162] 3'UTR |
| 183 | 219 | GGACUCUAAACAGGAACUU | 631 | AAGUUCCUGUUUAGAGUCC | | [1134-1152] 3'UTR |
| 184 | 220 | AUCACCAAGUAGCCACAAA | 632 | UUUGUGGCUACUUGGUGAU | | [83-101] 5'UTR |
| 185 | 221 | GAUCACCAAGUAGCCACAA | 633 | UUGUGGCUACUUGGUGAUC | | [82-100] 5'UTR |
| 186 | 222 | AAAUGAAAGUCUGAGCCAG | 634 | CUGGCUCAGACUUUCAUUU | | [386-404] ORF |
| 187 | 223 | GAAUAAAUGAAAGUCUGAG | 635 | CUCAGACUUUCAUUUAUUC | | [382-400] ORF |
| 188 | 224 | CUAUUAUGGAGAAAAGACG | 636 | CGUCUUUUCUCCAUAAUAG | | [355-373] ORF |
| 189 | 225 | AUCUGAGCACAGAAAAGUCA | 637 | UGACUUUCUGUGCUCAGAU | | [329-347] ORF |
| 190 | 226 | GUUUUGUGAAAGUCUCAAG | 638 | CUUGAGACUUUCACAAAAC | | [132-150] 5'UTR |
| 191 | 227 | CAUUUCGUUUUUACACGA | 639 | UCGUGUAAAAAACGAAAUG | Rat,Ms | [1330-1348] 3'UTR |
| 192 | 228 | AGGAACUUGAAUACUGGGA | 640 | UCCCAGUAUUCAAGUUCCU | | [1145-1163] 3'UTR |
| 193 | 229 | CCGGACUCUAAACAGGAAC | 641 | GUUCCUGUUUAGAGUCCGG | | [1132-1150] 3'UTR |
| 194 | 230 | UUUGCUUCCUCAUUCCCA | 642 | UGGGAAUGAGGAAAGCAAA | | [921-939] ORF |
| 195 | 231 | GGAAAUGACAGUGAAGCAC | 643 | GUGCUUCACUGUCAUUUCC | Rat | [479-497] ORF |
| 196 | 232 | GACAUUUCGUUUUUACAC | 644 | GUGUAAAAACGAAAUGUC | Rat,Ms | [1328-1346] 3'UTR |

FIGURE 4 Continued

| | | | | | | | |
|---|---|---|---|---|---|---|---|
| 197 | 233 | AUUUUGGAUGCUCUGAAGA | 645 | UCUUCAGAGCAUCCAAAAU | | [417-435] ORF |
| 198 | 234 | UAAAUGAAAGUCUGAGCCA | 646 | UGGCUCAGACUUUCAUUUA | | [385-403] ORF |
| 199 | 235 | UGUCAACACGACACCGGAU | 647 | AUCCGGUGUCGUGUUGACA | Chn | [296-314] ORF |
| 200 | 236 | CUUGCUCAGUAGUUUUGUG | 648 | CACAAAACUACUGAGCAAG | | [121-139] 5'UTR |
| 201 | 237 | UUUUAUGUGAUGCCAAAGA | 649 | UCUUUGGCAUCACAUAAAA | Rat,Ms | [1357-1375] 3'UTR |
| 202 | 238 | CGUUUUUUACACGAGAUUU | 650 | AAAUCUCGUGUAAAAAACG | Rat,Ms | [1335-1353] 3'UTR |
| 203 | 239 | UGUUCAUAUUGGAUUGCGC | 651 | GCGCAAUCCAAUAUGAACA | Rat,Ms | [1286-1304] 3'UTR |
| 204 | 240 | ACUGACCAUGCACUAUAUU | 652 | AAUAUAGUGCAUGGUCAGU | GP | [1252-1270] 3'UTR |
| 205 | 241 | UUGAAUACUGGGAGAGAAG | 653 | CUUCUCUCCCAGUAUUCAA | | [1151-1169] 3'UTR |
| 206 | 242 | CUCAAGUAAAAGAGACACA | 654 | UGUGUCUCUUUUACUUGAG | | [145-163] 5'UTR |
| 207 | 243 | UUGUAGAGAGCUGUAUU | 655 | AAUACAGCUCUCUCUACAA | | [1228-1246] 3'UTR |
| 208 | 244 | AGUUACUUUUUGUAGAGAG | 656 | CUCUCUACAAAAAGUAACU | Rat,Ms | [1219-1237] 3'UTR |
| 209 | 245 | UGAUUAAGUGGUUACUUUG | 657 | CAAAGUAACCACUUAAUCA | GP | [1180-1198] 3'UTR |
| 210 | 246 | GAGGACUUUUUUGAUUAAG | 658 | CUUAAUCAAAAAAGUCCUC | | [1169-1187] 3'UTR |
| 211 | 247 | GCCAGCUGAAAACACUGAU | 659 | AUCAGUGUUUUCAGCUGGC | GP,Chn | [400-418] ORF |
| 212 | 248 | UCAGCACUUGCUCAGUAGU | 660 | ACUACUGAGCAAGUGCUGA | | [115-133] 5'UTR |
| 213 | 249 | GAUUAAGUGGUUACUUUGU | 661 | ACAAAGUAACCACUUAAUC | GP | [1181-1199] 3'UTR |
| 214 | 250 | UAAGGUGUUUGGAGGCUUC | 662 | GAAGCCUCCAAACACCUUA | | [875-893] ORF |
| 215 | 251 | GCUACUGAUCACCAAGUAG | 663 | CUACUUGGUGAUCAGUAGC | | [76-94] 5'UTR |
| 216 | 252 | ACUGAUUUUGGAUGCUCUG | 664 | CAGAGCAUCCAAAAUCAGU | | [413-431] ORF |
| 217 | 253 | CUGAAAACACUGAUUUUGG | 665 | CCAAAAUCAGUGUUUUCAG | Rat,Ms,GP,Chn | [405-423] ORF |
| 218 | 254 | GUGCUGAUAACAGCGGAAU | 666 | AUUCCGCUGUUAUCAGCAC | Ms | [22-40] 5'UTR |
| 219 | 255 | UUAUGUGAUGCCAAAGAUG | 667 | CAUCUUUGGCAUCACAUAA | Rat,Ms | [1359-1377] 3'UTR |
| 220 | 256 | UGGAUUGCGCCUUUGUAUU | 668 | AAUACAAAGGCGCAAUCCA | Rat,Ms | [1295-1313] 3'UTR |
| 221 | 257 | GCUGUAUUAAGUGACUGAC | 669 | GUCAGUCACUUAAUACAGC | Rat,Ms,GP | [1239-1257] 3'UTR |
| 222 | 258 | ACUGGGAGAGAAGAGGACU | 670 | AGUCCUCUUCUCUCCCAGU | | [1157-1175] 3'UTR |
| 223 | 259 | AGCUGGUGCUGAUAACAGC | 671 | GCUGUUAUCAGCACCAGCU | Ms | [17-35] 5'UTR |
| 224 | 260 | UCAAAGCCUAUUAUGGAGA | 672 | UCUCCAUAAUAGGCUUUGA | | [348-366] ORF |
| 225 | 261 | CGGAUAAAACCAAAGACAGC | 673 | CGUGUCUUUGGUUUAUCCG | Chn | [310-328] ORF |
| 226 | 262 | UCUUUUUCGUGAAGAACUC | 674 | GAGUUCUUCACGAAAAAGA | | [174-192] 5'UTR |
| 227 | 263 | UGAAAGUCUCAAGUAAAAG | 675 | CUUUUACUUGAGACUUUCA | | [138-156] 5'UTR |
| 228 | 264 | UUUUGUGAAAGUCUCAAGU | 676 | ACUUGAGACUUUCACAAAA | | [133-151] 5'UTR |
| 229 | 265 | CUCAGUAGUUUUGUGAAAG | 677 | CUUUCACAAAACUACUGAG | | [125-143] 5'UTR |
| 230 | 266 | GACUCUAAACAGGAACUUG | 678 | CAAGUUCCUGUUUAGAGUC | | [1135-1153] 3'UTR |
| 231 | 267 | UUGGAUGCUCUGAAGAAAG | 679 | CUUUCUUCAGAGCAUCCAA | | [420-438] ORF |
| 232 | 268 | UAUUGGAUUGCGCCUUUGUA | 680 | ACAAAGGCGCAAUCCAAUA | Rat,Ms | [1292-1310] 3'UTR |
| 233 | 269 | GAGAGCUGUAUUAAGUGAC | 681 | GUCACUUAAUACAGCUCUC | Rat,Ms,GP | [1235-1253] 3'UTR |
| 234 | 270 | UCUGGAAAUGACAGUGAAG | 682 | CUUCACUGUCAUUUCCAGA | Rat | [476-494] ORF |
| 235 | 271 | AGCAUCUGAGCACAGAAGU | 683 | ACUUCUGUGCUCAGAUGCU | | [326-344] ORF |
| 236 | 272 | CCAAAGAUGUUUGAAAAUG | 684 | CAUUUUCAAACAUCUUUGG | Ms | [1369-1387] 3'UTR |
| 237 | 273 | UCAGAUGACAUUUCGUUUU | 685 | AAAACGAAAUGUCAUCUGA | | [1322-1340] 3'UTR |
| 238 | 274 | ACAGCGCUACUGAUCACCA | 686 | UGGUGAUCAGUAGCGCUGU | | [71-89] 5'UTR |
| 239 | 275 | UCUGAGCACAGAAAGUCAU | 687 | AUGACUUUCUGUGCUCAGA | Rat,Ms | [330-348] ORF |
| 240 | 276 | AGCACUUGCUCAGUAGUUU | 688 | AAACUACUGAGCAAGUGCU | | [117-135] 5'UTR |
| 241 | 277 | CAGCACUUGCUCAGUAGUU | 689 | AACUACUGAGCAAGUGCUG | | [116-134] 5'UTR |
| 242 | 278 | AUAAUAAACCCUCAGCACU | 690 | AGUGCUGAGGGUUUAUUAU | | [104-122] 5'UTR |
| 243 | 279 | UGUUUGGAGGCUUCCAGGU | 691 | ACCUGGAAGCCUCCAAACA | | [880-898] ORF |
| 244 | 280 | CAGCUGAAAACACUGAUUU | 692 | AAAUCAGUGUUUUCAGCUG | GP,Chn | [402-420] ORF |
| 245 | 281 | UCAUCAAAGCCUAUUAUGG | 693 | CCAUAAUAGGCUUUGAUGA | | [345-363] ORF |
| 246 | 282 | ACUUGCUCAGUAGUUUUGU | 694 | ACAAAACUACUGAGCAAGU | | [120-138] 5'UTR |
| 247 | 283 | CUGUAUUAAGUGACUGACC | 695 | GGUCAGUCACUUAAUACAG | Rat,Ms,GP | [1240-1258] 3'UTR |
| 248 | 284 | UUUGUAGAGAGCUGUAUU | 696 | AUACAGCUCUCUCUACAAA | | [1227-1245] 3'UTR |
| 249 | 285 | CUUUUUGUAGAGAGAGCUG | 697 | CAGCUCUCUCUACAAAAAG | | [1224-1242] 3'UTR |
| 250 | 286 | UACUGGGAGAGAAGAGGAC | 698 | GUCCUCUUCUCUCCCAGUA | | [1156-1174] 3'UTR |
| 251 | 287 | CCAGAUCAAUGCCAUGACC | 699 | GGUCAUGGCAUUGAUCUGG | | [680-698] ORF |
| 252 | 288 | GCAUGACCCAGAUCAAUGC | 700 | GCAUUGAUCUGGGUCAUGC | | [673-691] ORF |
| 253 | 289 | CUCUGAAGAAAGAUAGCUC | 701 | GAGCUAUCUUUCUUCAGAG | | [427-445] ORF |
| 254 | 290 | GCUGAAAACACUGAUUUUG | 702 | CAAAAUCAGUGUUUUCAGC | GP,Chn | [404-422] ORF |
| 255 | 291 | CACCGGAUAAAACCAAAGAC | 703 | GUCUUUGGUUUAUCCGGUG | Chn | [307-325] ORF |
| 256 | 292 | CAGUAGUUUUGUGAAAGUC | 704 | GACUUUCACAAAACUACUG | | [127-145] 5'UTR |
| 257 | 293 | GUUUUUUACACGAGAUUUC | 705 | GAAAUCUCGUGUAAAAAAC | Rat,Ms | [1336-1354] 3'UTR |
| 258 | 294 | AACCCUCAGCACUUGCUCA | 706 | UGAGCAAGUGCUGAGGGUU | | [110-128] 5'UTR |
| 259 | 295 | AAAAGCUCAGAUGACAUUU | 707 | AAAUGUCAUCUGAGCUUUU | | [1316-1334] 3'UTR |
| 260 | 296 | UUAUAAAAGCUCAGAUGAC | 708 | GUCAUCUGAGCUUUUAUAA | | [1312-1330] 3'UTR |
| 261 | 297 | UGCUUUCCUCAUUCCCAAC | 709 | GUUGGGAAUGAGGAAAGCA | | [923-941] ORF |
| 262 | 298 | CGAUGGCCAGUUUGCUUUC | 710 | GAAAGCAAACUGGCCAUCG | | [911-929] ORF |
| 263 | 299 | CCCAGAUCAAUGCCAUGAC | 711 | GUCAUGGCAUUGAUCUGGG | | [679-697] ORF |
| 264 | 300 | GCUCUGAAGAAAGAUAGCU | 712 | AGCUAUCUUUCUUCAGAGC | | [426-444] ORF |

FIGURE 4 Continued

| | | | | | | | |
|---|---|---|---|---|---|---|---|
| 265 | 301 | AGCGCUACUGAUCACCAAG | 713 | CUUGGUGAUCAGUAGCGCU | | [73-91] 5'UTR |
| 266 | 302 | AUGAAAGUCUGAGCCAGCU | 714 | AGCUGGCUCAGACUUUCAU | | [388-406] ORF |
| 267 | 303 | AUCAAAGCCUAUUAUGGAG | 715 | CUCCAUAAUAGGCUUUGAU | | [347-365] ORF |
| 268 | 304 | UGAGCACAGAAAGUCAUCA | 716 | UGAUGACUUUCUGUGCUCA | Rat,Ms | [332-350] ORF |
| 269 | 305 | CUCAGCACUUGCUCAGUAG | 717 | CUACUGAGCAAGUGCUGAG | | [114-132] 5'UTR |
| 270 | 306 | UAUAAUAAACCCUCAGCAC | 718 | GUGCUGAGGGUUUAUUAUA | | [103-121] 5'UTR |
| 271 | 307 | GACUUUUUUGAUUAAGUGG | 719 | CCACUUAAUCAAAAAAGUC | | [1172-1190] 3'UTR |
| 272 | 308 | GCUAAGGUGUUUGGAGGCU | 720 | AGCCUCCAAACACCUUAGC | | [873-891] ORF |
| 273 | 309 | AGGGCGUUAAUACCGAGGU | 721 | ACCUCGGUAUUAACGCCCU | | [622-640] ORF |
| 274 | 310 | UGAGCACAGACCCAAGUGU | 722 | ACACUUGGGUCUGUGCUCA | | [535-553] ORF |
| 275 | 311 | GUCAUCAAAGCCUAUUAUG | 723 | CAUAAUAGGCUUUGAUGAC | | [344-362] ORF |
| 276 | 312 | UAAACCAAAGACAGCAUCU | 724 | AGAUGCUGUCUUUGGUUUA | | [314-332] ORF |
| 277 | 313 | GGAGAAAAAUUCCUCGUCC | 725 | GGACGAGGAAUUUUUCUCC | Rat,Chn | [254-272] ORF |
| 278 | 314 | UUGCUCAGUAGUUUUGUGA | 726 | UCACAAAACUACUGAGCAA | | [122-140] 5'UTR |
| 279 | 315 | GAGCUGUAUUAAGUGACUG | 727 | CAGUCACUUAAUACAGCUC | Rat,Ms,GP | [1237-1255] 3'UTR |
| 280 | 316 | GCAUUCCAAGCUGGAGAAG | 728 | CUUCUCCAGCUUGGAAUGC | Rat,GP,Chn | [449-467] ORF |
| 281 | 317 | UCUGAGCCAGCUGAAAACA | 729 | UGUUUUCAGCUGGCUCAGA | | [395-413] ORF |
| 282 | 318 | GCCUUUGUAUUAUAAAAGC | 730 | GCUUUUAUAAUACAAAGGC | | [1303-1321] 3'UTR |
| 283 | 319 | AAGUGACUGACCAUGCACU | 731 | AGUGCAUGGUCAGUCACUU | Rat,Ms,GP | [1247-1265] 3'UTR |
| 284 | 320 | GAGCCAGCUGAAAACACUG | 732 | CAGUGUUUUCAGCUGGCUC | Chn | [398-416] ORF |
| 285 | 321 | AAUGAAAGUCUGAGCCAGU | 733 | GCUGGCUCAGACUUUCAUU | | [387-405] ORF |
| 286 | 322 | UGGAGAAAAGACGAAGAGC | 734 | GCUCUUCGUCUUUUCUCCA | | [361-379] ORF |
| 287 | 323 | AUGGAGAAAAGACGAAGAG | 735 | CUCUUCGUCUUUUCUCCAU | GP | [360-378] ORF |
| 288 | 324 | CCAAAGACAGCAUCUGAGC | 736 | GCUCAGAUGCUGUCUUUGG | | [318-336] ORF |
| 289 | 325 | UCUCUCCUUGGUCCUGGAA | 737 | UUCCAGGACCAAGGAGAA | Rat,Ms | [53-71] 5'UTR |
| 290 | 326 | UCGUUUUUUACACGGAUU | 738 | AAUCCGUGUAAAAAACGA | Rat,Ms | [1334-1352] 3'UTR |
| 291 | 327 | ACUUUUUGUAGAGAGAGCU | 739 | AGCUCUCUCUACAAAAAGU | | [1223-1241] 3'UTR |
| 292 | 328 | UUAAGUGGUUACUUUGUGU | 740 | ACACAAAGUAACCACUUAA | | [1183-1201] 3'UTR |
| 293 | 329 | AAACAGGAACUUGAAUACU | 741 | AGUAUUCAAGUUCCUGUUU | | [1141-1159] 3'UTR |
| 294 | 330 | GAUCAAUGCCAUGACCUAC | 742 | GUAGGUCAUGGCAUUGAUC | | [683-701] ORF |
| 295 | 331 | UUAUGGAGAAAAGACGAAG | 743 | CUUCGUCUUUUCUCCAUAA | | [358-376] ORF |
| 296 | 332 | AACACGACACCGGAUAAAC | 744 | GUUUAUCCGGUGUCGUGUU | Chn | [300-318] ORF |
| 297 | 333 | UGGCCAGUUUGCUUUCCUC | 745 | GAGGAAAGCAAACUGGCCA | | [914-932] ORF |
| 298 | 334 | AACUGCAUGACCCAGAUCA | 746 | UGAUCUGGGUCAUGCAGUU | Rat,Ms,GP,Chn | [669-687] ORF |
| 299 | 335 | UCUGAAGAAAGAUAGCUCG | 747 | CGAGCUAUCUUUCUUCAGA | | [428-446] ORF |
| 300 | 336 | AUGCUCUGAAGAAAGAUAG | 748 | CUAUCUUUCUUCAGAGCAU | | [424-442] ORF |
| 301 | 337 | CUGAGCCAGCUGAAAACAC | 749 | GUGUUUUCAGCUGGCUCAG | Chn | [396-414] ORF |
| 302 | 338 | ACCAAAGACAGCAUCUUGG | 750 | CUCAGAUGCUGUCUUUGGU | | [317-335] ORF |
| 303 | 339 | UGCUGAUAACAGCGGAAUC | 751 | GAUUCCGCUGUUAUCAGCA | Ms | [23-41] 5'UTR |
| 304 | 340 | UGUGAUGCCAAAGAUGUUU | 752 | AAACAUCUUUGGCAUCACA | Rat,Ms | [1362-1380] 3'UTR |
| 305 | 341 | GACAUUCUGGAAAUGACAG | 753 | CUGUCAUUUCCAGAAUGUC | Rat | [471-489] ORF |
| 306 | 342 | AGACAGCAUCUGAGCACAG | 754 | CUGUGCUCAGAUGCUGUCU | | [322-340] ORF |
| 307 | 343 | GAGAAAAAUUCCUCGUCCC | 755 | GGGACGAGGAAUUUUUCUC | Rat,Chn | [255-273] ORF |
| 308 | 344 | UUCGUUUUUUACACGAGAU | 756 | AUCUCGUGUAAAAAACGAA | Rat,Ms | [1333-1351] 3'UTR |
| 309 | 345 | CAGAUCAAUGGCCAUGACCU | 757 | AGGUCAUGGCCAUUGAUCUG | | [681-699] ORF |
| 310 | 346 | UGCAUGACCCAGAUCAAUG | 758 | CAUUGAUCUGGGUCAUGCA | | [672-690] ORF |
| 311 | 347 | ACUGAUCACCAAGUAGCCA | 759 | UGGCUACUUGGUGAUCAGU | | [79-97] 5'UTR |
| 312 | 348 | ACACGACACCGGAUAAACC | 760 | GGUUUAUCCGGUGUCGUGU | Chn | [301-319] ORF |
| 313 | 349 | UACUUUUGUAGAGAGAGC | 761 | GCUCUCUCUACAAAAAGUA | | [1222-1240] 3'UTR |
| 314 | 350 | CUGAAGAAAGAUAGCUCGC | 762 | GCGAGCUAUCUUUCUUCAG | | [429-447] ORF |
| 315 | 351 | AGCCAGCUGAAAACACUGA | 763 | UCAGUGUUUUCAGCUGGCU | GP,Chn | [399-417] ORF |
| 316 | 352 | AAAGUCAUCAAAGCCUAUU | 764 | AAUAGGCUUUGAUGACUUU | | [341-359] ORF |
| 317 | 353 | CUGAGCACAGAAAGUCAUC | 765 | GAUGACUUUCUGUGCUCAG | Rat,Ms | [331-349] ORF |
| 318 | 354 | AGUCUCAAGUAAAAGAGAC | 766 | GUCUCUUUUACUUGAGACU | | [142-160] 5'UTR |
| 319 | 355 | UGCUCUGAAGAAAGAUAGC | 767 | GCUAUCUUUCUUCAGAGCA | | [425-443] ORF |
| 320 | 356 | UAAAAUAUCUUCCUUUGGG | 768 | CCCAAAGGAAGAUAUUUUA | Rat,Ms | [1392-1410] 3'UTR |
| 321 | 357 | GUGAUGCCAAAGAUGUUUG | 769 | CAAACAUCUUUGGCAUCAC | Rat,Ms | [1363-1381] 3'UTR |
| 322 | 358 | AAUCUGGGAGGAAGAAGAGG | 770 | CCUCUUCUCUCCCAGUAUU | | [1154-1172] 3'UTR |
| 323 | 359 | AUAAAAUGAAAGUCUGAGC | 771 | GCUCAGACUUUCAUUUUAU | | [383-401] ORF |
| 324 | 360 | AAACCAAAGACAGCAUCUG | 772 | CAGAUGCUGUCUUUGGUUU | | [315-333] ORF |
| 325 | 361 | AGUUUGCUUUCCUCAUUCC | 773 | GGAAUGAGGAAAGCAAACU | | [919-937] ORF |
| 326 | 362 | CUGGAAAUGACAGUGAAGC | 774 | GCUUCACUGUCAUUUCCAG | Rat | [477-495] ORF |
| 327 | 363 | CAUUCCAAGCUGGAGAAGG | 775 | CCUUCUCCAGCUUGGAAUG | Rat,GP,Chn | [450-468] ORF |
| 328 | 364 | AACACUGAUUUGGAUGCU | 776 | AGCAUCCAAAAUCAGUGUU | | [410-428] ORF |
| 329 | 365 | UUUUUAUGUGAUGCCAAAA | 777 | CUUUGGCAUCACAUAAAAA | Rat,Ms | [1356-1374] 3'UTR |
| 330 | 366 | AAAGCUCAGAUGACAUUUC | 778 | GAAAUGUCAUCUGAGCUUU | | [1317-1335] 3'UTR |
| 331 | 367 | AUUCUGGAAAUGACAGUGA | 779 | UCACUGUCAUUUCCAGAAU | Rat | [474-492] ORF |
| 332 | 368 | ACAGAAAGUCAUCAAAGCC | 780 | GGCUUUGAUGACUUUCUGU | Rat,Ms,GP,Chn | [337-355] ORF |

FIGURE 4 Continued

| | | | | | | | |
|---|---|---|---|---|---|---|---|
| 333 | 369 | AUGCCAGCUGAUAUAAUGG | 781 | CCAUUAUAUCAGCUGGCAU | Rat,Ms,Chn | [237-255] ORF |
| 334 | 370 | UCAUAUUGGAUUGCGCCUU | 782 | AAGGCGCAAUCCAAUAUGA | Rat,Ms | [1289-1307] 3'UTR |
| 335 | 371 | GUUUGCUUUCCUCAUUCCC | 783 | GGGAAUGAGGAAAGCAAAC | | [920-938] ORF |
| 336 | 372 | AAGAAAGAUAGCUCGCGGC | 784 | GCCGCGAGCUAUCUUUCUU | | [432-450] ORF |
| 337 | 373 | AUGGAGAAAAAUUCCUCGU | 785 | ACGAGGAAUUUUUCUCCAU | Rat,Chn | [252-270] ORF |
| 338 | 374 | GUCUACCUCUCUCCUUGGU | 786 | ACCAAGGAGAGAGGUAGAC | Rat,Ms | [46-64] 5'UTR |
| 339 | 375 | AAGAUGUUUGAAAAUGCUC | 787 | GAGCAUUUUCAAACAUCUU | Ms | [1372-1390] 3'UTR |
| 340 | 376 | UUUUUGUAGAGAGCUGU | 788 | ACAGCUCUCUCUACAAAAA | | [1225-1243] 3'UTR |
| 341 | 377 | GAAAUGACAGUGAAGCACC | 789 | GGUGCUUCACUGUCAUUUC | Rat | [480-498] ORF |
| 342 | 378 | UGCUCUUAAAAUAUCUUCC | 790 | GGAAGAUAUUUUAAGAGCA | Rat,Ms | [1386-1404] 3'UTR |
| 343 | 379 | UAUUAAGUGACUGACCAUG | 791 | CAUGGUCAGUCACUUAAUA | Rat,Ms,GP | [1243-1261] 3'UTR |
| 344 | 380 | AAAACACUGAUUUUGGAUG | 792 | CAUCCAAAAUCAGUGUUUU | Rat,Ms,GP,Chn | [408-426] ORF |
| 345 | 381 | UCAAUGCCAUGACCUACCC | 793 | GGGUAGGUCAUGGCAUUGA | | [685-703] ORF |
| 346 | 382 | ACAUUCUGGAAAUGACAGU | 794 | ACUGUCAUUUCCAGAAUGU | Rat | [472-490] ORF |
| 347 | 383 | UGAAGAAAGAUAGCUCGCG | 795 | CGCGAGCUAUCUUUCUUCA | | [430-448] ORF |
| 348 | 384 | UGGAGAAAAAUUCCUCGUC | 796 | GACGAGGAAUUUUUCUCCA | Rat,Chn | [253-271] ORF |
| 349 | 385 | UUUUUCGUGAAGAACUCCA | 797 | UGGAGUUCUUCACGAAAAA | | [176-194] 5'UTR |
| 350 | 386 | UACUGAUCACCAAGUAGCC | 798 | GGCUACUUGGUGAUCAGUA | | [78-96] 5'UTR |
| 351 | 387 | AUUCCAAGCUGGAGAAGGC | 799 | GCCUUCUCCAGCUUGGAAU | Rat,GP,Chn | [451-469] ORF |
| 352 | 388 | CAUCUGAGCACAGAAAGUC | 800 | GACUUUCUGUGCUCAGAUG | | [328-346] ORF |
| 353 | 389 | AAAGUCUCAAGUAAAAGAG | 801 | CUCUUUUACUUGAGACUUU | | [140-158] 5'UTR |
| 354 | 390 | AUAUUGGAUUGCGCCUUUG | 802 | CAAAGGCGCAAUCCAAUAU | Rat,Ms | [1291-1309] 3'UTR |
| 355 | 391 | UCCCUCCGGACUCUAAACA | 803 | UGUUUAGAGUCCGGAGGGA | | [1127-1145] 3'UTR |
| 356 | 392 | CAACUGCAUGACCCAGAUC | 804 | GAUCUGGGUCAUGCAGUUG | Rat,Ms,GP,Chn | [668-686] ORF |
| 357 | 393 | AAACACUGAUUUUGGAUGU | 805 | GCAUCCAAAAUCAGUGUUU | Rat,Ms,GP,Chn | [409-427] ORF |
| 358 | 394 | AAAGACAGCAUCUGAGCAC | 806 | GUGCUCAGAUGCUGUCUUU | | [320-338] ORF |
| 359 | 395 | AAUGGAGAAAAAUUCCUCG | 807 | CGAGGAAUUUUUCUCCAUU | Rat,Chn | [251-269] ORF |
| 360 | 396 | UUCUUUUUCGUGAAGAACU | 808 | AGUUCUUCACGAAAAAGAA | | [173-191] 5'UTR |
| 361 | 397 | UUACUUUUUGUAGAGAGAG | 809 | CUCUCUCUACAAAAAGUAA | | [1221-1239] 3'UTR |
| 362 | 398 | ACCCAGAUCAAUGCCAUGA | 810 | UCAUGGCAUUGAUCUGGGU | | [678-696] ORF |
| 363 | 399 | AUGACCCAGAUCAAUGCCA | 811 | UGGCAUUGAUCUGGGUCAU | | [675-693] ORF |
| 364 | 400 | CUUCAGCGAGUGCAUGAAC | 812 | GUUCAUGCACUCGCUGAAG | Rat,Ms,GP,Chn | [575-593] ORF |
| 365 | 401 | CAUUCUGGAAAUGACAGUG | 813 | CACUGUCAUUUCCAGAAUG | Rat | [473-491] ORF |
| 366 | 402 | CACUUGCUCAGUAGUUUUG | 814 | CAAAACUACUGAGCAAGUG | | [119-137] 5'UTR |
| 367 | 403 | AUGGCCAGUUUGCUUUCCU | 815 | AGGAAAGCAAACUGGCCAU | | [913-931] ORF |
| 368 | 404 | UGAAAGUCUGAGCCAGCUG | 816 | CAGCUGGCUCAGACUUUCA | | [389-407] ORF |
| 369 | 405 | AUUUCGUUUUUUACACGAG | 817 | CUCGUGUAAAAAACGAAAU | Rat,Ms | [1331-1349] 3'UTR |
| 370 | 406 | UAAGUGGUUACUUUGUGUU | 818 | AACACAAAGUAACCACUUA | | [1184-1202] 3'UTR |
| 371 | 407 | AAUAUAAUAAACCCUCAGC | 819 | GCUGAGGGUUUAUUAUAUU | | [101-119] 5'UTR |
| 372 | 408 | CUUUCCUCAUUCCCAACGG | 820 | CCGUUGGGAAUGAGGAAAG | | [925-943] ORF |
| 373 | 409 | CUACUGAUCACCAAGUAGC | 821 | GCUACUUGGUGAUCAGUAG | | [77-95] 5'UTR |
| 374 | 410 | ACAUUUCGUUUUUUACACG | 822 | CGUGUAAAAAACGAAAUGU | Rat,Ms | [1329-1347] 3'UTR |
| 375 | 411 | GUUCAUAUUGGAUUGCGCC | 823 | GGCGCAAUCCAAUAUGAAC | Rat,Ms | [1287-1305] 3'UTR |
| 376 | 412 | UAAGUGACUGACCAUGCAC | 824 | GUGCAUGGUCAGUCACUUA | Rat,Ms,GP | [1246-1264] 3'UTR |
| 377 | 413 | AUUAAGUGACUGACCAUGU | 825 | GCAUGGUCAGUCACUUAAU | Rat,Ms,GP | [1244-1262] 3'UTR |
| 378 | 414 | CUGAUCACCAAGUAGCCAC | 826 | GUGGCUACUUGGUGAUCAG | | [80-98] 5'UTR |
| 379 | 415 | UAAGGAGAAAAAUUCCUC | 827 | GAGGAAUUUUUCUCCAUUA | Rat,Ms,Chn | [250-268] ORF |
| 380 | 416 | UUCCCUCCGGACUCUAAAC | 828 | GUUUAGAGUCCGGAGGGAA | | [1126-1144] 3'UTR |
| 381 | 417 | GCUUUCCUCAUUCCCAACG | 829 | CGUUGGGAAUGAGGAAAGC | | [924-942] ORF |
| 382 | 418 | CAUGACCCAGAUCAAUGCC | 830 | GGCAUUGAUCUGGGUCAUG | | [674-692] ORF |
| 383 | 419 | ACACUGAUUUUGGAUGCUC | 831 | GAGCAUCCAAAAUCAGUGU | | [411-429] ORF |
| 384 | 420 | AUAAACCAAAGACAGCAUC | 832 | GAUGCUGUCUUUGGUUUAU | | [313-331] ORF |
| 385 | 421 | GCUGAUAACAGCGGAAUCC | 833 | GGAUUCCGCUGUUAUCAGC | Ms | [24-42] 5'UTR |
| 386 | 422 | UUAAUACCGAGGUGCGCAC | 834 | GUGCGCACCUCGGUAUUAA | | [628-646] ORF |
| 387 | 423 | CUGAUAACAGCGGAAUCCC | 835 | GGGAUUCCGCUGUUAUCAG | Ms | [25-43] 5'UTR |
| 388 | 424 | UAAACCCUCAGCACUUGCU | 836 | AGCAAGUGCUGAGGGUUUA | | [108-126] 5'UTR |
| 389 | 425 | AUUAAGUGGUUACUUUGUG | 837 | CACAAAGUAACCACUUAAU | | [1182-1200] 3'UTR |
| 390 | 426 | AACUUGAAUACUGGGAGAG | 838 | CUCUCCCAGUAUUCAAGUU | | [1148-1166] 3'UTR |
| 391 | 427 | AAACCCUCAGCACUUGCUC | 839 | GAGCAAGUGCUGAGGGUUU | | [109-127] 5'UTR |
| 392 | 428 | UAAUACCGAGGUGCGCACU | 840 | AGUGCGCACCUCGGUAUUA | | [629-647] ORF |
| 393 | 429 | AAGAUAGCUCGCGGCAUUC | 841 | GAAUGCCGCGAGCUAUCUU | | [436-454] ORF |
| 394 | 430 | UCUCAAGUAAAAGACACGA | 842 | GUGUCUUUUACUUGAGA | | [144-162] 5'UTR |
| 395 | 431 | UUCAGCGAGUGCAUGAACG | 843 | CGUUCAUGCACUCGCUGAA | Rat,Ms,GP,Chn | [576-594] ORF |
| 396 | 432 | AUUCUUUUUCGUGAAGAAC | 844 | GUUCUUCACGAAAAAGAAU | | [172-190] 5'UTR |
| 397 | 433 | UUCAUAUUGGAUUGCGCCU | 845 | AGGCGCAAUCCAAUAUGAA | Rat,Ms | [1288-1306] 3'UTR |
| 398 | 434 | UUUCCUCAUUCCCAACGGG | 846 | CCCGUUGGGAAUGAGGAAA | | [926-944] ORF |
| 399 | 435 | UACCUCUCUCCUUGGUCCU | 847 | AGGACCAAGGAGAGGGUA | Rat,Ms | [49-67] 5'UTR |
| 400 | 436 | AUAAAUGAAAGUCUGAGCC | 848 | GGCUCAGACUUUCAUUUAU | | [384-402] ORF |

FIGURE 4 Continued

| | | | | | | | |
|---|---|---|---|---|---|---|---|
| 401 | 437 | CUUUUUCGUGAAGAACUCC | 849 | GGAGUUCUUCACGAAAAAG | | [175-193] 5'UTR |
| 402 | 438 | AUGUUCAUAUUGGAUUGCG | 850 | CGCAAUCCAAUAUGAACAU | Rat,Ms | [1285-1303] 3'UTR |
| 403 | 439 | GAUGGCCAGUUUGCUUCC | 851 | GGAAAGCAAACUGGCCAUC | | [912-930] ORF |
| 404 | 440 | AAGGUGUUUGGAGGCUUCC | 852 | GGAAGCCUCCAAACACCUU | | [876-894] ORF |
| 405 | 441 | AUGACAGUGAAGCACCUCC | 853 | GGAGGUGCUUCACUGUCAU | Rat,GP,Chn | [483-501] ORF |
| 406 | 442 | UUCUUUUUUAUGUGAUGCC | 854 | GGCAUCACAUAAAAAAGAA | | [1352-1370] 3'UTR |
| 407 | 443 | AUCAAUGCCAUGACCUACC | 855 | GGUAGGUCAUGGCAUUGAU | | [684-702] ORF |
| 408 | 444 | UCUACCUCUCUCCUUGGUC | 856 | GACCAAGGAGAGGUAGA | Rat,Ms | [47-65] 5'UTR |
| 409 | 445 | AUAAACCCUCAGCACUUGC | 857 | GCAAGUGCUGAGGGUUUAU | | [107-125] 5'UTR |
| 410 | 446 | AAUGACAGUGAAGCACCUC | 858 | GAGGUGCUUCACUGUCAUU | Rat | [482-500] ORF |
| 411 | 447 | UAUGUUCAUAUUGGAUUGC | 859 | GCAAUCCAAUAUGAACAUA | Rat,Ms | [1284-1302] 3'UTR |
| 412 | 448 | AACAGCGCUACUGAUCACC | 860 | GGUGAUCAGUAGCGCUGUU | | [70-88] 5'UTR |

| | | | | | | | |
|---|---|---|---|---|---|---|---|
| 262 | 861 | CAUUCUGGAAAUGACAGUGAAGC | 1244 | GCUUCACUGUCAUUUCCAGAAUG | Rat | [473-495] ORF |
| 263 | 862 | ACAUUCUGGAAAUGACAGUGAAG | 1245 | CUUCACUGUCAUUUCCAGAAUGU | Rat | [472-494] ORF |
| 264 | 863 | GACAUUCUGGAAAUGACAGUGAA | 1246 | UUCACUGUCAUUUCCAGAAUGUC | Rat | [471-493] ORF |
| 265 | 864 | AACACUGAUUUUGGAUGCUCUGA | 1247 | UCAGAGCAUCCAAAAUCAGUGUU | | [410-432] ORF |
| 266 | 865 | AAACACUGAUUUUGGAUGCUCUG | 1248 | CAGAGCAUCCAAAAUCAGUGUUU | | [409-431] ORF |
| 267 | 866 | AAAACACUGAUUUUGGAUGCUCU | 1249 | AGAGCAUCCAAAAUCAGUGUUUU | | [408-430] ORF |
| 268 | 867 | GUAUUAAGUGACUGACCAUGCAC | 1250 | GUGCAUGGUCAGUCACUUAAUAC | Rat,Ms,GP | [1242-1264] 3'UTR |
| 269 | 868 | UGUAUUAAGUGACUGACCAUGCA | 1251 | UGCAUGGUCAGUCACUUAAUACA | Rat,Ms,GP | [1241-1263] 3'UTR |
| 270 | 869 | CUGUAUUAAGUGACUGACCAUGC | 1252 | GCAUGGUCAGUCACUUAAUACAG | Rat,Ms,GP | [1240-1262] 3'UTR |
| 271 | 870 | GCUGUAUUAAGUGACUGACCAUG | 1253 | CAUGGUCAGUCACUUAAUACAGC | Rat,Ms,GP | [1239-1261] 3'UTR |
| 272 | 871 | AGCUGUAUUAAGUGACUGACCAU | 1254 | AUGGUCAGUCACUUAAUACAGCU | Rat,Ms,GP | [1238-1260] 3'UTR |
| 273 | 872 | GCAUCUGAGCACAGAAAGUCAUC | 1255 | GAUGACUUUCUGUGCUCAGAUGC | | [327-349] ORF |
| 274 | 873 | AGCAUCUGAGCACAGAAAGUCAU | 1256 | AUGACUUUCUGUGCUCAGAUGCU | | [326-348] ORF |
| 275 | 874 | AAAGACAGCAUCUGAGCACAGAA | 1257 | UUCUGUGCUCAGAUGCUGUCUUU | | [320-342] ORF |
| 276 | 875 | GUGAAGAACUCCAAAAAUAAAAU | 1258 | AUUUUAUUUUUGGAGUUCUUCAC | | [182-204] 5'UTR |
| 277 | 876 | CUUUUUCGUGAAGAACUCCAAAA | 1259 | UUUUGGAGUUCUUCACGAAAAAG | | [175-197] 5'UTR |
| 278 | 877 | UCUUUUUCGUGAAGAACUCCAAA | 1260 | UUUGGAGUUCUUCACGAAAAAGA | | [174-196] 5'UTR |
| 279 | 878 | AGAUCAAUGCCAUGACCUACCCC | 1261 | GGGGUAGGUCAUGGCAUUGAUCU | | [682-704] ORF |
| 280 | 879 | CAGAUCAAUGCCAUGACCUACCC | 1262 | GGGUAGGUCAUGGCAUUGAUCUG | | [681-703] ORF |
| 281 | 880 | CCAGAUCAAUGCCAUGACCUACC | 1263 | GGUAGGUCAUGGCAUUGAUCUGG | | [680-702] ORF |
| 282 | 881 | CCCAGAUCAAUGCCAUGACCUAC | 1264 | GUAGGUCAUGGCAUUGAUCUGGG | | [679-701] ORF |
| 283 | 882 | ACCCAGAUCAAUGCCAUGACCUA | 1265 | UAGGUCAUGGCAUUGAUCUGGGU | | [678-700] ORF |
| 284 | 883 | AUAGCUCGCGGCAUUCCAAGCUG | 1266 | CAGCUUGGAAUGCCGCGAGCUAU | | [439-461] ORF |
| 285 | 884 | GAUAGCUCGCGGCAUUCCAAGCU | 1267 | AGCUUGGAAUGCCGCGAGCUAUC | | [438-460] ORF |
| 286 | 885 | AGAUAGCUCGCGGCAUUCCAAGC | 1268 | GCUUGGAAUGCCGCGAGCUAUCU | | [437-459] ORF |
| 287 | 886 | AAGAUAGCUCGCGGCAUUCCAAG | 1269 | CUUGGAAUGCCGCGAGCUAUCUU | | [436-458] ORF |
| 288 | 887 | AAAGAUAGCUCGCGGCAUUCCAA | 1270 | UUGGAAUGCCGCGAGCUAUCUUU | | [435-457] ORF |
| 289 | 888 | CGCUACUGAUCACCAAGUAGCCA | 1271 | UGGCUACUUGGUGAUCAGUAGCG | | [75-97] 5'UTR |
| 290 | 889 | GCGCUACUGAUCACCAAGUAGCC | 1272 | GGCUACUUGGUGAUCAGUAGCGC | | [74-96] 5'UTR |
| 291 | 890 | AGCGCUACUGAUCACCAAGUAGC | 1273 | GCUACUUGGUGAUCAGUAGCGCU | | [73-95] 5'UTR |
| 292 | 891 | AUGAAAGUCUGAGCCAGCUGAAA | 1274 | UUUCAGCUGGCUCAGACUUUCAU | | [388-410] ORF |
| 293 | 892 | AAUGAAAGUCUGAGCCAGCUGAA | 1275 | UUCAGCUGGCUCAGACUUUCAUU | | [387-409] ORF |
| 294 | 893 | AAAUGAAGUCUGAGCCAGCUGA | 1276 | UCAGCUGGCUCAGACUUUCAUUU | | [386-408] ORF |
| 295 | 894 | UGGAAAUGACAGUGAAGCACCUC | 1277 | GAGGUGCUUCACUGUCAUUUCCA | Rat | [478-500] ORF |
| 296 | 895 | CUGGAAAUGACAGUGAAGCACCU | 1278 | AGGUGCUUCACUGUCAUUUCCAG | Rat | [477-499] ORF |
| 297 | 896 | UCUGGAAAUGACAGUGAAGCACC | 1279 | GGUGCUUCACUGUCAUUUCCAGA | Rat | [476-498] ORF |
| 298 | 897 | CCGGACUCUAAACAGGAACUUGA | 1280 | UCAAGUUCCUGUUUAGAGUCCGG | | [1132-1154] 3'UTR |
| 299 | 898 | CCAGUUUGCUUUCCUCAUUCCCA | 1281 | UGGGAAUGAGGAAAGCAAACUGG | | [917-939] ORF |
| 300 | 899 | GAGCUGGUGCUGAUAACAGCGGA | 1282 | UCCGCUGUUAUCAGCACCAGCUC | Ms | [16-38] 5'UTR |
| 301 | 900 | UGGAACAGCGCUACUGAUCACCA | 1283 | UGGUGAUCAGUAGCGCUGUUCCA | | [67-89] 5'UTR |
| 302 | 901 | CCAUGCACUAUAUUUGUAUAUAU | 1284 | AUAUAUACAAAUAUAGUGCAUGG | | [1257-1279] 3'UTR |
| 303 | 902 | ACCAUGCACUAUAUUUGUAUAUA | 1285 | UAUAUACAAAUAUAGUGCAUGGU | | [1256-1278] 3'UTR |
| 304 | 903 | GACCAUGCACUAUAUUUGUAUAU | 1286 | AUAUACAAAUAUAGUGCAUGGUC | | [1255-1277] 3'UTR |
| 305 | 904 | UGACCAUGCACUAUAUUUGUAUA | 1287 | UAUACAAAUAUAGUGCAUGGUCA | | [1254-1276] 3'UTR |
| 306 | 905 | CUGACCAUGCACUAUAUUUGUAU | 1288 | AUACAAAUAUAGUGCAUGGUCAG | | [1253-1275] 3'UTR |
| 307 | 906 | CCAGCUGAAAACACUGAUUUUGG | 1289 | CCAAAAUCAGUGUUUUCAGCUGG | GP,Chn | [401-423] ORF |
| 308 | 907 | GCCAGCUGAAAACACUGAUUUUG | 1290 | CAAAAUCAGUGUUUUCAGCUGGC | GP,Chn | [400-422] ORF |
| 309 | 908 | AGCCAGCUGAAAACACUGAUUUU | 1291 | AAAAUCAGUGUUUUCAGCUGGCU | GP,Chn | [399-421] ORF |
| 310 | 909 | UGUGAUGCCAAAGAUGUUUGAAA | 1292 | UUUCAAACAUCUUUGGCAUCACA | Rat,Ms | [1362-1384] 3'UTR |
| 311 | 910 | AUGUGAUGCCAAAGAUGUUUGAA | 1293 | UUCAAACAUCUUUGGCAUCACAU | Rat,Ms | [1361-1383] 3'UTR |
| 312 | 911 | UAUGUGAUGCCAAAGAUGUUUGA | 1294 | UCAAACAUCUUUGGCAUCACAUA | Rat,Ms | [1360-1382] 3'UTR |
| 313 | 912 | CUUUUUGUAGAGAGCUGUAUU | 1295 | AAUACAGCUCUCUCUACAAAAAG | | [1224-1246] 3'UTR |
| 314 | 913 | ACUUUUUGUAGAGAGCUGUAU | 1296 | AUACAGCUCUCUCUACAAAAAGU | | [1223-1245] 3'UTR |
| 315 | 914 | UACUUUUUGUAGAGAGCUGUA | 1297 | UACAGCUCUCUCUACAAAAAGUA | | [1222-1244] 3'UTR |

FIGURE 4 Continued

| | | | | | | | |
|---|---|---|---|---|---|---|---|
| 316 | 915 | GAAAGAUAGCUCGCGGCAUUCCA | 1298 | UGGAAUGCCGCGAGCUAUCUUUC | | [434-456] ORF |
| 317 | 916 | AGAAAGAUAGCUCGCGGCAUUCC | 1299 | GGAAUGCCGCGAGCUAUCUUUCU | | [433-455] ORF |
| 318 | 917 | AAGAAAGAUAGCUCGCGGCAUUC | 1300 | GAAUGCCGCGAGCUAUCUUUCUU | | [432-454] ORF |
| 319 | 918 | GAAGAAAGAUAGCUCGCGGCAUU | 1301 | AAUGCCGCGAGCUAUCUUUCUUC | | [431-453] ORF |
| 320 | 919 | UGAAGAAAGAUAGCUCGCGGCAU | 1302 | AUGCCGCGAGCUAUCUUUCUUCA | | [430-452] ORF |
| 321 | 920 | GAGCUGUAUUAAGUGACUGACCA | 1303 | UGGUCAGUCACUUAAUACAGCUC | Rat,Ms,GP | [1237-1259] 3'UTR |
| 322 | 921 | AGAGCUGUAUUAAGUGACUGACC | 1304 | GGUCAGUCACUUAAUACAGCUCU | Rat,Ms,GP | [1236-1258] 3'UTR |
| 323 | 922 | GAGAGCUGUAUUAAGUGACUGAC | 1305 | GUCAGUCACUUAAUACAGCUCUC | Rat,Ms,GP | [1235-1257] 3'UTR |
| 324 | 923 | AGAGAGCUGUAUUAAGUGACUGA | 1306 | UCAGUCACUUAAUACAGCUCUCU | Rat,Ms,GP | [1234-1256] 3'UTR |
| 325 | 924 | AGAGAGAGCUGUAUUAAGUGACU | 1307 | AGUCACUUAAUACAGCUCUCUCU | | [1232-1254] 3'UTR |
| 326 | 925 | UAGAGAGAGCUGUAUUAAGUGAC | 1308 | GUCACUUAAUACAGCUCUCUCUA | | [1231-1253] 3'UTR |
| 327 | 926 | AAAGUCAUCAAAGCCUAUUAUGG | 1309 | CCAUAAUAGGCUUUGAUGACUUU | | [341-363] ORF |
| 328 | 927 | GAAAGUCUCAAGUAAAAGAGACA | 1310 | UGUCUCUUUUACUUGAGACUUUC | | [139-161] 5'UTR |
| 329 | 928 | UGAAAGUCUCAAGUAAAAGAGAC | 1311 | GUCUCUUUUACUUGAGACUUUCA | | [138-160] 5'UTR |
| 330 | 929 | UAGUUUUGUGAAAGUCUCAAGUA | 1312 | UACUUGAGACUUUCACAAAACUA | | [130-152] 5'UTR |
| 331 | 930 | GUAGUUUUGUGAAAGUCUCAAGU | 1313 | ACUUGAGACUUUCACAAAACUAC | | [129-151] 5'UTR |
| 332 | 931 | AGUAGUUUUGUGAAAGUCUCAAG | 1314 | CUUGAGACUUUCACAAAACUACU | | [128-150] 5'UTR |
| 333 | 932 | CAGUAGUUUUGUGAAAGUCUCAA | 1315 | UUGAGACUUUCACAAAACUACUG | | [127-149] 5'UTR |
| 334 | 933 | GAGAGAGCUGUAUUAAGUGACUG | 1316 | CAGUCACUUAAUACAGCUCUCUC | Rat,Ms,GP | [1233-1255] 3'UTR |
| 335 | 934 | GAAGAGGACUUUUUUGAUUAAGU | 1317 | ACUUAAUCAAAAAAGUCCUCUUC | | [1166-1188] 3'UTR |
| 336 | 935 | UCCGGACUCUAAACAGGAACUUG | 1318 | CAAGUUCCUGUUUAGAGUCCGGA | | [1131-1153] 3'UTR |
| 337 | 936 | CUCCGGACUCUAAACAGGAACUU | 1319 | AAGUUCCUGUUUAGAGUCCGGAG | | [1130-1152] 3'UTR |
| 338 | 937 | CCUCCGGACUCUAAACAGGAACU | 1320 | AGUUCCUGUUUAGAGUCCGGAGG | | [1129-1151] 3'UTR |
| 339 | 938 | CCCUCCGGACUCUAAACAGGAAC | 1321 | GUUCCUGUUUAGAGUCCGGAGGG | | [1128-1150] 3'UTR |
| 340 | 939 | CCCUCCCGGACUCUAAACAGGAA | 1322 | UUCCUGUUUAGAGUCCGGAGGGA | | [1127-1149] 3'UTR |
| 341 | 940 | CUGCAUGACCCAGUCAAUGCCA | 1323 | UGGCAUUGAUCUGGGUCAUGCAG | | [671-693] ORF |
| 342 | 941 | AUUAUGGAGAAAAGACGAAGAGC | 1324 | GCUCUUCGUCUUUUCUCCAUAAU | | [357-379] ORF |
| 343 | 942 | UAUUAUGGAGAAAAGACGAAGAG | 1325 | CUCUUCGUCUUUUCUCCAUAAUA | | [356-378] ORF |
| 344 | 943 | CUAUUAUGGAGAAAAGACGAAGA | 1326 | UCUUCGUCUUUUCUCCAUAAUAG | | [355-377] ORF |
| 345 | 944 | CCUAUUAUGGAGAAAAGACGAAG | 1327 | CUUCGUCUUUUCUCCAUAAUAGG | | [354-376] ORF |
| 346 | 945 | AUAUUGGAUUGCGCCUUUGUAUU | 1328 | AAUACAAAGGCGCAAUCCAAUAU | Rat,Ms | [1291-1313] 3'UTR |
| 347 | 946 | CAUAUUGGAUUGCGCCUUUGUAU | 1329 | AUACAAAGGCGCAAUCCAAUAUG | Rat,Ms | [1290-1312] 3'UTR |
| 348 | 947 | UCAUAUUGGAUUGCGCCUUUGUA | 1330 | UACAAAGGCGCAAUCCAAUAUGA | Rat,Ms | [1289-1311] 3'UTR |
| 349 | 948 | UAAGUGACUGACCAUGCACUAUA | 1331 | UAUAGUGCAUGGUCAGUCACUUA | GP | [1246-1268] 3'UTR |
| 350 | 949 | UUAAGUGACUGACCAUGCACUAU | 1332 | AUAGUGCAUGGUCAGUCACUUAA | Rat,Ms,GP | [1245-1267] 3'UTR |
| 351 | 950 | AUUAAGUGACUGACCAUGCACUA | 1333 | UAGUGCAUGGUCAGUCACUUAAU | Rat,Ms,GP | [1244-1266] 3'UTR |
| 352 | 951 | UAUUAAGUGACUGACCAUGCACU | 1334 | AGUGCAUGGUCAGUCACUUAAUA | Rat,Ms,GP | [1243-1265] 3'UTR |
| 353 | 952 | AGGACUUUUUUGAUUAAAGUGGUU | 1335 | AACCACUUAAUCAAAAAAGUCCU | | [1170-1192] 3'UTR |
| 354 | 953 | GAGGACUUUUUUGAUUAAGUGGU | 1336 | ACCACUUAAUCAAAAAAGUCCUC | | [1169-1191] 3'UTR |
| 355 | 954 | AGAGGACUUUUUUGAUUAAGUGG | 1337 | CCACUUAAUCAAAAAAGUCCUCU | | [1168-1190] 3'UTR |
| 356 | 955 | AAGAGGACUUUUUUGAUUAAGUG | 1338 | CACUUAAUCAAAAAAGUCCUCUU | | [1167-1189] 3'UTR |
| 357 | 956 | CCUCUCUUCCCUCCGGACUCUAA | 1339 | UUAGAGUCCGGAGGGAAGAGAGG | | [1120-1142] 3'UTR |
| 358 | 957 | AACCAAAGACAGCAUCUGAGCAC | 1340 | GUGCUCAGAUGCUGUCUUUGGUU | | [316-338] ORF |
| 359 | 958 | AAACCAAAGACAGCAUCUGAGCA | 1341 | UGCUCAGAUGCUGUCUUUGGUUU | | [315-337] ORF |
| 360 | 959 | UAAACCAAAGACAGCAUCUGAGC | 1342 | GCUCAGAUGCUGUCUUUGGUUUA | | [314-336] ORF |
| 361 | 960 | AUAAACCAAAGACAGCAUCUGAG | 1343 | CUCAGAUGCUGUCUUUGGUUUAU | | [313-335] ORF |
| 362 | 961 | GAUAAACCAAAGACAGCAUCUGA | 1344 | UCAGAUGCUGUCUUUGGUUUAUC | | [312-334] ORF |
| 363 | 962 | ACUGACCAUGCACUAUAUUUGGA | 1345 | UACAAAUAUAGUGCAUGGUCAGU | GP | [1252-1274] 3'UTR |
| 364 | 963 | AAAUGCCAGCUGAUAUAAUGGAG | 1346 | CUCCAUUAUAUCAGCUGGCAUUU | Rat,Ms,Chn | [235-257] 5'UTR+ORF |
| 365 | 964 | AAAAUGCCAGCUGAUAUAAUGGA | 1347 | UCCAUUAUAUCAGCUGGCAUUUU | Rat,Ms,Chn | [234-256] 5'UTR+ORF |
| 366 | 965 | UGAAUACUGGGAGAAGAGGAC | 1348 | GUCCUCUUCUCUCCCAGUAUUCA | | [1152-1174] 3'UTR |
| 367 | 966 | UUGAAUACUGGGAGAAGAGGA | 1349 | UCCUCUUCUCUCCCAGUAUUCAA | | [1151-1173] 3'UTR |
| 368 | 967 | CUAAACAGGAACUUGAAUACUGG | 1350 | CCAGUAUUCAAGUUCCUGUUUAG | | [1139-1161] 3'UTR |
| 369 | 968 | UCUAAACAGGAACUUGAAUACUG | 1351 | CAGUAUUCAAGUUCCUGUUUAGA | | [1138-1160] 3'UTR |
| 370 | 969 | UCAGUAGUUUUGUGAAAGUCUCA | 1352 | UGAGACUUUCACAAAACUACUGA | | [126-148] 5'UTR |
| 371 | 970 | GAUGUUUGAAAAUGCUCUUAAAA | 1353 | UUUUAAGAGCAUUUUCAAACAUC | Ms | [1374-1396] 3'UTR |
| 372 | 971 | AGAUGUUUGAAAAUGCUCUUAAA | 1354 | UUUAAGAGCAUUUUCAAACAUCU | Ms | [1373-1395] 3'UTR |
| 373 | 972 | AAGAUGUUUGAAAAUGCUCUUAA | 1355 | UUAAGAGCAUUUUCAAACAUCUU | Ms | [1372-1394] 3'UTR |
| 374 | 973 | AAAGAUGUUUGAAAAUGCUCUUA | 1356 | UAAGAGCAUUUUCAAACAUCUUU | Ms | [1371-1393] 3'UTR |
| 375 | 974 | CAAAGAUGUUUGAAAAUGCUCUU | 1357 | AAGAGCAUUUUCAAACAUCUUUG | Ms | [1370-1392] 3'UTR |
| 376 | 975 | GUGGUUACUUUGUGUUUUUUUAA | 1358 | UUAAAAAAACACAAAGUAACCAC | | [1187-1209] 3'UTR |
| 377 | 976 | AGUGGUUACUUUGUGUUUUUUUA | 1359 | UAAAAAAACACAAAGUAACCACU | | [1186-1208] 3'UTR |
| 378 | 977 | AAGUGGUUACUUUGUGUUUUUUU | 1360 | AAAAAAACACAAAGUAACCACUU | | [1185-1207] 3'UTR |
| 379 | 978 | UAAGUGGUUACUUUGUGUUUUUU | 1361 | AAAAAACACAAAGUAACCACUUA | | [1184-1206] 3'UTR |
| 380 | 979 | UUAAGUGGUUACUUUGUGUUUUU | 1362 | AAAAACACAAAGUAACCACUUAA | | [1183-1205] 3'UTR |
| 381 | 980 | AUACUGGGAGAAGAGGACUUU | 1363 | AAAGUCCUCUUCUCUCCCAGUAU | | [1155-1177] 3'UTR |
| 382 | 981 | AAUACUGGGAGAAGAGGACUU | 1364 | AAGUCCUCUUCUCUCCCAGUAUU | | [1154-1176] 3'UTR |
| 383 | 982 | ACGUGCGAGGGCGUUAAUACCGA | 1365 | UCGGUAUUAACGCCCUCGCACGU | | [615-637] ORF |

FIGURE 4 Continued

| | | | | | | | |
|---|---|---|---|---|---|---|---|
| 384 | 983 | CACGUGCGAGGGCGUUAAUACCG | 1366 | CGGUAUUAACGCCCUCGCACGUG | | | [614-636] ORF |
| 385 | 984 | CCACGUGCGAGGGCGUUAAUACC | 1367 | GGUAUUAACGCCCUCGCACGUGG | | | [613-635] ORF |
| 386 | 985 | UCCACGUGCGAGGGCGUUAAUAC | 1368 | GUAUUAACGCCCUCGCACGUGGA | | | [612-634] ORF |
| 387 | 986 | GUCCACGUGCGAGGGCGUUAAUA | 1369 | UAUUAACGCCCUCGCACGUGGAC | | | [611-633] ORF |
| 388 | 987 | UAUAAAAGCUCAGAUGACAUUUC | 1370 | GAAAUGUCAUCUGAGCUUUUAUA | | | [1313-1335] 3'UTR |
| 389 | 988 | UUAUAAAAGCUCAGAUGACAUUU | 1371 | AAAUGUCAUCUGAGCUUUUAUAA | | | [1312-1334] 3'UTR |
| 390 | 989 | AUUAUAAAAGCUCAGAUGACAUU | 1372 | AAUGUCAUCUGAGCUUUUAUAAU | | | [1311-1333] 3'UTR |
| 391 | 990 | UAUUAUAAAAGCUCAGAUGACAU | 1373 | AUGUCAUCUGAGCUUUUAUAAUA | | | [1310-1332] 3'UTR |
| 392 | 991 | GUAUUAUAAAAGCUCAGAUGACA | 1374 | UGUCAUCUGAGCUUUUAUAAUAC | | | [1309-1331] 3'UTR |
| 393 | 992 | CUCAGAUGACAUUUCGUUUUUA | 1375 | UAAAAAACGAAAUGUCAUCUGAG | | | [1321-1343] 3'UTR |
| 394 | 993 | GCUCAGAUGACAUUUCGUUUUU | 1376 | AAAAAACGAAAUGUCAUCUGAGC | | | [1320-1342] 3'UTR |
| 395 | 994 | AGCUCAGAUGACAUUUCGUUUU | 1377 | AAAAACGAAAUGUCAUCUGAGCU | | | [1319-1341] 3'UTR |
| 396 | 995 | AAGCUCAGAUGACAUUUCGUUUU | 1378 | AAAACGAAAUGUCAUCUGAGCUU | | | [1318-1340] 3'UTR |
| 397 | 996 | AAAGCUCAGAUGACAUUUCGUUU | 1379 | AAACGAAAUGUCAUCUGAGCUUU | | | [1317-1339] 3'UTR |
| 398 | 997 | GCCAAAGAUGUUUGAAAAUGCUC | 1380 | GAGCAUUUUCAAACAUCUUUGG | | Ms | [1368-1390] 3'UTR |
| 399 | 998 | CCUCAGCACUUGCUCAGUAGUUU | 1381 | AAACUACUGAGCAAGUGCUGAGG | | | [113-135] 5'UTR |
| 400 | 999 | CCCUCAGCACUUGCUCAGUAGUU | 1382 | AACUACUGAGCAAGUGCUGAGGG | | | [112-134] 5'UTR |
| 401 | 1000 | ACCCUCAGCACUUGCUCAGUAGU | 1383 | ACUACUGAGCAAGUGCUGAGGGU | | | [111-133] 5'UTR |
| 402 | 1001 | AACCCUCAGCACUUGCUCAGUAG | 1384 | CUACUGAGCAAGUGCUGAGGGUU | | | [110-132] 5'UTR |
| 403 | 1002 | AAACCCUCAGCACUUGCUCAGUA | 1385 | UACUGAGCAAGUGCUGAGGGUUU | | | [109-131] 5'UTR |
| 404 | 1003 | UUCAUAUUGGAUUGCGCCUUUGU | 1386 | ACAAAGGCGCAAUCCAAUAUGAA | Rat,Ms | | [1288-1310] 3'UTR |
| 405 | 1004 | GUUCAUAUUGGAUUGCGCCUUUG | 1387 | CAAAGGCGCAAUCCAAUAUGAAC | Rat,Ms | | [1287-1309] 3'UTR |
| 406 | 1005 | UGUUCAUAUUGGAUUGCGCCUUU | 1388 | AAAGGCGCAAUCCAAUAUGAACA | Rat,Ms | | [1286-1308] 3'UTR |
| 407 | 1006 | UCUCCUUGGUCCUGGAACAGCGC | 1389 | GCGCUGUUCCAGGACCAAGGAGA | | | [55-77] 5'UTR |
| 408 | 1007 | CUCUCCUUGGUCCUGGAACAGCG | 1390 | CGCUGUUCCAGGACCAAGGAGAG | | | [54-76] 5'UTR |
| 409 | 1008 | UCUCUCCUUGGUCCUGGAACAGC | 1391 | GCUGUUCCAGGACCAAGGAGAGA | | | [53-75] 5'UTR |
| 410 | 1009 | CUCUCUCCUUGGUCCUGGAACAG | 1392 | CUGUUCCAGGACCAAGGAGAGAG | | | [52-74] 5'UTR |
| 411 | 1010 | CCUCUCUCCUUGGUCCUGGAACA | 1393 | UGUUCCAGGACCAAGGAGAGAGG | | | [51-73] 5'UTR |
| 412 | 1011 | CCAAAGAUGUUUGAAAAUGCUCU | 1394 | AGAGCAUUUUCAAACAUCUUUGG | | Ms | [1369-1391] 3'UTR |
| 413 | 1012 | UUUCGUUUUUUACACGAGAUUUC | 1395 | GAAAUCUCGUGUAAAAAACGAAA | Rat,Ms | | [1332-1354] 3'UTR |
| 414 | 1013 | AUUUCGUUUUUUACACGAGAUUU | 1396 | AAAUCUCGUGUAAAAAACGAAAU | Rat,Ms | | [1331-1353] 3'UTR |
| 415 | 1014 | CAUUUCGUUUUUUACACGAGAUU | 1397 | AAUCUCGUGUAAAAAACGAAAU | Rat,Ms | | [1330-1352] 3'UTR |
| 416 | 1015 | ACAUUUCGUUUUUUACACGAGAU | 1398 | AUCUCGUGUAAAAAACGAAAUGU | Rat,Ms | | [1329-1351] 3'UTR |
| 417 | 1016 | GACAUUUCGUUUUUUACACGAGA | 1399 | UCUCGUGUAAAAAACGAAAUGUC | Rat,Ms | | [1328-1350] 3'UTR |
| 418 | 1017 | AACAGGAACUUGAAUACUGGGAG | 1400 | CUCCCAGUAUUCAAGUUCCUGUU | | | [1142-1164] 3'UTR |
| 419 | 1018 | GCUUCAGCGAGUGCAUGAACGAG | 1401 | CUCGUUCAUGCACUCGCUGAAGC | Rat,Ms,GP,Chn | | [574-596] ORF |
| 420 | 1019 | GGCUUCAGCGAGUGCAUGAACGA | 1402 | UCGUUCAUGCACUCGCUGAAGCC | Rat,Ms,GP,Chn | | [573-595] ORF |
| 421 | 1020 | CGGCUUCAGCGAGUGCAUGAACG | 1403 | CGUUCAUGCACUCGCUGAAGCCG | Rat,Ms,GP,Chn | | [572-594] ORF |
| 422 | 1021 | CCGGCUUCAGCGAGUGCAUGAAC | 1404 | GUUCAUGCACUCGCUGAAGCCGG | Rat,Ms,GP,Chn | | [571-593] ORF |
| 423 | 1022 | GCCGGCUUCAGCGAGUGCAUGAA | 1405 | UUCAUGCACUCGCUGAAGCCGGC | Rat,Ms,GP,Chn | | [570-592] ORF |
| 424 | 1023 | GAAAACACUGAUUUUGGAUGCUC | 1406 | GAGCAUCCAAAAUCAGUGUUUUC | Rat,Ms,GP,Chn | | [407-429] ORF |
| 425 | 1024 | CAGAUGACAUUUCGUUUUUUACA | 1407 | UGUAAAAAACGAAAUGUCAUCUG | | | [1323-1345] 3'UTR |
| 426 | 1025 | UCAGAUGACAUUUCGUUUUUUAC | 1408 | GUAAAAAACGAAAUGUCAUCUGA | | | [1322-1344] 3'UTR |
| 427 | 1026 | AAAAGCUCAGAUGACAUUUCGUU | 1409 | AACGAAAUGUCAUCUGAGCUUUU | | | [1316-1338] 3'UTR |
| 428 | 1027 | UAAAAGCUCAGAUGACAUUUCGU | 1410 | ACGAAAUGUCAUCUGAGCUUUUA | | | [1315-1337] 3'UTR |
| 429 | 1028 | AGAUACUGGGAGAAGAAGGACU | 1411 | AGUCCUUCUUCUCCCAGUAUUC | | | [1153-1175] 3'UTR |
| 430 | 1029 | AAACAGGAACUUGAAUACUGGGA | 1412 | UCCCAGUAUUCAAGUUCCUGUUU | | | [1141-1163] 3'UTR |
| 431 | 1030 | UAAACAGGAACUUGAAUACUGGG | 1413 | CCCAGUAUUCAAGUUCCUGUUUA | | | [1140-1162] 3'UTR |
| 432 | 1031 | CGAUGGCCAGUUUGCUUUCCUCA | 1414 | UGAGGAAAGCAAACUGGCCAUCG | | | [911-933] ORF |
| 433 | 1032 | ACUGAUCACCAAGUAGCCACAAA | 1415 | UUUGUGGCUACUUGGUGAUCAGU | | | [79-101] 5'UTR |
| 434 | 1033 | UACUGAUCACCAAGUAGCCACAA | 1416 | UUGUGGCUACUUGGUGAUCAGUA | | | [78-100] 5'UTR |
| 435 | 1034 | CUACUGAUCACCAAGUAGCCACA | 1417 | UGUGGCUACUUGGUGAUCAGUAG | | | [77-99] 5'UTR |
| 436 | 1035 | CAAAGACAGCAUCUGAGCACAGA | 1418 | UCUGUGCUCAGAUGCUGUCUUUG | | | [319-341] ORF |
| 437 | 1036 | CCAAAGACAGCAUCUGAGCACAG | 1419 | CUGUGCUCAGAUGCUGUCUUUGG | | | [318-340] ORF |
| 438 | 1037 | ACCAAAGACAGCAUCUGAGCACA | 1420 | UGUGCUCAGAUGCUGUCUUUGGU | | | [317-339] ORF |
| 439 | 1038 | ACACCGGAUAAACCAAAGACAGC | 1421 | GCUGUCUUUGGUUUAUCCGGUGU | | Chn | [306-328] ORF |
| 440 | 1039 | GACACCGGAUAAACCAAAGACAG | 1422 | CUGUCUUUGGUUUAUCCGGUGUC | | Chn | [305-327] ORF |
| 441 | 1040 | AAGUCUCAAGUAAAAGAGACACA | 1423 | UGUGUCUCUUUUACUUGAGACUU | | | [141-163] 5'UTR |
| 442 | 1041 | AAAGUCUCAAGUAAAAGAGACAC | 1424 | GUGUCUCUUUUACUUGAGACUUU | | | [140-162] 5'UTR |
| 443 | 1042 | AACGCAGUGUCACCUUCCAGCGG | 1425 | CCGCUGGAAGGUGACACUGCGUU | | Ms | [1011-1033] ORF |
| 444 | 1043 | CAACGCAGUGUCACCUUCCAGCG | 1426 | CGCUGGAAGGUGACACUGCGUUG | | Ms | [1010-1032] ORF |
| 445 | 1044 | CCAACGCAGUGUCACCUUCCAGC | 1427 | GCUGGAAGGUGACACUGCGUUGG | | Ms | [1009-1031] ORF |
| 446 | 1045 | CCCAACGCAGUGUCACCUUCCAG | 1428 | CUGGAAGGUGACACUGCGUUGGG | | Ms | [1008-1030] ORF |
| 447 | 1046 | CCCCAACGCAGUGUCACCUUCCA | 1429 | UGGAAGGUGACACUGCGUUGGGG | | Ms | [1007-1029] ORF |
| 448 | 1047 | GACCCGAUCAAUGCCAUGACCU | 1430 | AGGUCAUGGCAUUGAUCGGGUC | | | [677-699] ORF |
| 449 | 1048 | UGACCCAGAUCAAUGCCAUGACC | 1431 | GGUCAUGGCAUUGAUCUGGGUCA | | | [676-698] ORF |
| 450 | 1049 | AUGACCCAGAUCAAUGCCAUGAC | 1432 | GUCAUGGCAUUGAUCUGGGUCAU | | | [675-697] ORF |
| 451 | 1050 | CAUGACCCAGAUCAAUGCCAUGA | 1433 | UCAUGGCAUUGAUCUGGGUCAUG | | | [674-696] ORF |

FIGURE 4 Continued

| # | ID | Sequence 1 | ID2 | Sequence 2 | Species | Position |
|---|---|---|---|---|---|---|
| 452 | 1051 | GCAUGACCCAGAUCAAUGCCAUG | 1434 | CAUGGCAUUGAUCUGGGUCAUGC | | [673-695] ORF |
| 453 | 1052 | GAGUGCAUGAACGAGGUGACCCG | 1435 | CGGGUCACCUCGUUCAUGCACUC | Rat,Ms,GP,Chn | [582-604] ORF |
| 454 | 1053 | CGAGUGCAUGAACGAGGUGACCC | 1436 | GGGUCACCUCGUUCAUGCACUCG | Rat,Ms,GP,Chn | [581-603] ORF |
| 455 | 1054 | GCGAGUGCAUGAACGAGGUGACC | 1437 | GGUCACCUCGUUCAUGCACUCGC | Rat,Ms,GP,Chn | [580-602] ORF |
| 456 | 1055 | AGCGAGUGCAUGAACGAGGUGAC | 1438 | GUCACCUCGUUCAUGCACUCGCU | Rat,Ms,GP,Chn | [579-601] ORF |
| 457 | 1056 | CAGCGAGUGCAUGAACGAGGUGA | 1439 | UCACCUCGUUCAUGCACUCGCUG | Rat,Ms,GP,Chn | [578-600] ORF |
| 458 | 1057 | CUGGAGAAGGCGGACAUUCUGGA | 1440 | UCCAGAAUGUCCGCCUUCUCCAG | | [459-481] ORF |
| 459 | 1058 | CUGAAGAAAGAUAGCUCGCGGCA | 1441 | UGCCGCGAGCUAUCUUUCUUCAG | | [429-451] ORF |
| 460 | 1059 | GCACUUGCUCAGUAGUUUUGUGA | 1442 | UCACAAAACUACUGAGCAAGUGC | | [118-140] 5'UTR |
| 461 | 1060 | AGCACUUGCUCAGUAGUUUUGUG | 1443 | CACAAAACUACUGAGCAAGUGCU | | [117-139] 5'UTR |
| 462 | 1061 | CAGCACUUGCUCAGUAGUUUUGU | 1444 | ACAAAACUACUGAGCAAGUGCUG | | [116-138] 5'UTR |
| 463 | 1062 | UCAGCACUUGCUCAGUAGUUUUG | 1445 | CAAAACUACUGAGCAAGUGCUGA | | [115-137] 5'UTR |
| 464 | 1063 | CUCAGCACUUGCUCAGUAGUUUU | 1446 | AAAACUACUGAGCAAGUGCUGAG | | [114-136] 5'UTR |
| 465 | 1064 | AUAAAAGCUCAGAUGACAUUUCG | 1447 | CGAAAUGUCAUCUGAGCUUUUAU | | [1314-1336] 3'UTR |
| 466 | 1065 | AAGAAGUUACUUUUUGUAGAGAG | 1448 | CUCUCUACAAAAAGUAACUUCUU | | [1215-1237] 3'UTR |
| 467 | 1066 | UAAGAAGUUACUUUUUGUAGAGA | 1449 | UCUCUACAAAAAGUAACUUCUUA | | [1214-1236] 3'UTR |
| 468 | 1067 | CUAAGAAGUUACUUUUUGUAGAG | 1450 | CUCUACAAAAAGUAACUUCUUAG | | [1213-1235] 3'UTR |
| 469 | 1068 | UUCCCUCCGGACUCUAAACAGGA | 1451 | UCCUGUUUAGAGUCCGGAGGGAA | | [1126-1148] 3'UTR |
| 470 | 1069 | GAGCCAGCUGAAAACACUGAUUU | 1452 | AAAUCAGUGUUUUCAGCUGGCUC | | [398-420] ORF |
| 471 | 1070 | UGAGCCAGCUGAAAACACUGAUU | 1453 | AAUCAGUGUUUUCAGCUGGCUCA | GP,Chn | [397-419] ORF |
| 472 | 1071 | CUCAGUAGUUUUGUGAAAGUCUC | 1454 | GAGACUUUCACAAAACUACUGAG | | [125-147] 5'UTR |
| 473 | 1072 | UGCAUGACCCAGAUCAAUGCCAU | 1455 | AUGGCAUUGAUCUGGGUCAUGCA | | [672-694] ORF |
| 474 | 1073 | UCUGAAGAAAGAUAGCUCGCGGC | 1456 | GCCGCGAGCUAUCUUUCUUCAGA | | [428-450] ORF |
| 475 | 1074 | CUCUGAAGAAAGAUAGCUCGCGG | 1457 | CCGCGAGCUAUCUUUCUUCAGAG | | [427-449] ORF |
| 476 | 1075 | UUCCUUUUCGUGAAGAACUCCAA | 1458 | UUGGAGUUCUUCACGAAAAAGAA | | [173-195] 5'UTR |
| 477 | 1076 | UUUAUGUGAUGCCAAAGAUGUUU | 1459 | AAACAUCUUUGGCAUCACAUAAA | Rat,Ms | [1358-1380] 3'UTR |
| 478 | 1077 | UUUUAUGUGAUGCCAAAGAUGUU | 1460 | AACAUCUUUGGCAUCACAUAAAA | Rat,Ms | [1357-1379] 3'UTR |
| 479 | 1078 | UUUUUAUGUGAUGCCAAAGAUGU | 1461 | ACAUCUUUGGCAUCACAUAAAAA | Rat,Ms | [1356-1378] 3'UTR |
| 480 | 1079 | UUUUUUAUGUGAUGCCAAAGAUG | 1462 | CAUCUUUGGCAUCACAUAAAAAA | Rat,Ms | [1355-1377] 3'UTR |
| 481 | 1080 | CGCCUUUGUAUUAUAAAAGCUCA | 1463 | UGAGCUUUUAUAAUACAAAGGCG | | [1302-1324] 3'UTR |
| 482 | 1081 | UAAUAAACCCUCAGCACUUGCUC | 1464 | GAGCAAGUGCUGAGGGUUUAUUA | | [105-127] 5'UTR |
| 483 | 1082 | AUAAUAAACCCUCAGCACUUGCU | 1465 | AGCAAGUGCUGAGGGUUUAUUAU | | [104-126] 5'UTR |
| 484 | 1083 | UAUAAUAAACCCUCAGCACUUGC | 1466 | GCAAGUGCUGAGGGUUUAUUAUA | | [103-125] 5'UTR |
| 485 | 1084 | AUAUAAUAAACCCUCAGCACUUG | 1467 | CAAGUGCUGAGGGUUUAUUAUAU | | [102-124] 5'UTR |
| 486 | 1085 | AAUAUAAUAAACCCUCAGCACUU | 1468 | AAGUGCUGAGGGUUUAUUAUAUU | | [101-123] 5'UTR |
| 487 | 1086 | AAAUAUAAUAAACCCUCAGCACU | 1469 | AGUGCUGAGGGUUUAUUAUAUUU | | [100-122] 5'UTR |
| 488 | 1087 | AAAAUAUAAUAAACCCUCAGCAC | 1470 | GUGCUGAGGGUUUAUUAUAUUUU | | [99-121] 5'UTR |
| 489 | 1088 | CAAAAUAUAAUAAACCCUCAGCA | 1471 | UGCUGAGGGUUUAUUAUAUUUUG | | [98-120] 5'UTR |
| 490 | 1089 | AGAGGCGGCUAAGGUGUUUGGAG | 1472 | CUCCAAACACCUUAGCCGCCUCU | | [866-888] ORF |
| 491 | 1090 | GAGAGGCGGCUAAGGUGUUUGGA | 1473 | UCCAAACACCUUAGCCGCCUCUC | | [865-887] ORF |
| 492 | 1091 | GGAGAGGCGGCUAAGGUGUUUGG | 1474 | CCAAACACCUUAGCCGCCUCUCC | | [864-886] ORF |
| 493 | 1092 | UGGAGAGGCGGCUAAGGUGUUUG | 1475 | CAAACACCUUAGCCGCCUCUCCA | | [863-885] ORF |
| 494 | 1093 | CUGGAGAGGCGGCUAAGGUGUUU | 1476 | AAACACCUUAGCCGCCUCUCCAG | | [862-884] ORF |
| 495 | 1094 | GCUGGAGAAGGCGGACAUUCUGG | 1477 | CCAGAAUGUCCGCCUUCUCCAGC | | [458-480] ORF |
| 496 | 1095 | AGCUGGAGAAGGCGGACAUUCUG | 1478 | CAGAAUGUCCGCCUUCUCCAGCU | | [457-479] ORF |
| 497 | 1096 | AAGCUGGAGAAGGCGGACAUUCU | 1479 | AGAAUGUCCGCCUUCUCCAGCUU | | [456-478] ORF |
| 498 | 1097 | UUAUGUGAUGCCAAAGAUGUUUG | 1480 | CAAACAUCUUUGGCAUCACAUAA | Rat,Ms | [1359-1381] 3'UTR |
| 499 | 1098 | UCAGCGAGUGCAUGAACGAGGUG | 1481 | CACCUCGUUCAUGCACUCGCUGA | Rat,Ms,GP,Chn | [577-599] ORF |
| 500 | 1099 | UUCAGCGAGUGCAUGAACGAGGU | 1482 | ACCUCGUUCAUGCACUCGCUGAA | Rat,Ms,GP,Chn | [576-598] ORF |
| 501 | 1100 | CUUCAGCGAGUGCAUGAACGAGG | 1483 | CCUCGUUCAUGCACUCGCUGAAG | Rat,Ms,GP,Chn | [575-597] ORF |
| 502 | 1101 | AGCCAGUGUCAACACGACACCGG | 1484 | CCGGUGUCGUGUUGACACUGGCU | Rat,Ms | [290-312] ORF |
| 503 | 1102 | CAGCCAGUGUCAACACGACACCG | 1485 | CGGUGUCGUGUUGACACUGGCUG | Rat,Ms | [289-311] ORF |
| 504 | 1103 | CCAGCCAGUGUCAACACGACACC | 1486 | GGUGUCGUGUUGACACUGGCUGG | Rat,Ms | [288-310] ORF |
| 505 | 1104 | CCCAGCCAGUGUCAACACGACAC | 1487 | GUGUCGUGUUGACACUGGCUGGG | Rat,Ms | [287-309] ORF |
| 506 | 1105 | CCCCAGCCAGUGUCAACACGACA | 1488 | UGUCGUGUUGACACUGGCUGGGG | Rat,Ms | [286-308] ORF |
| 507 | 1106 | CUAAGGUGUUUGGAGGCUUCCAG | 1489 | CUGGAAGCCUCCAAACACCUUAG | | [874-896] ORF |
| 508 | 1107 | GCUAAGGUGUUUGGAGGCUUCCA | 1490 | UGGAAGCCUCCAAACACCUUAGC | | [873-895] ORF |
| 509 | 1108 | GGCUAAGGUGUUUGGAGGCUUCC | 1491 | GGAAGCCUCCAAACACCUUAGCC | | [872-894] ORF |
| 510 | 1109 | CGGCUAAGGUGUUUGGAGGCUUC | 1492 | GAAGCCUCCAAACACCUUAGCCG | | [871-893] ORF |
| 511 | 1110 | GCGGCUAAGGUGUUUGGAGGCUU | 1493 | AAGCCUCCAAACACCUUAGCCGC | | [870-892] ORF |
| 512 | 1111 | AGUGCAUGAACGAGGUGACCCGC | 1494 | GCGGGUCACCUCGUUCAUGCACU | Rat,Ms,GP,Chn | [583-605] ORF |
| 513 | 1112 | AAAUGACAGUGAAGCACCUCCGG | 1495 | CCGGAGGUGCUUCACUGUCAUUU | Rat | [481-503] ORF |
| 514 | 1113 | GAAAUGACAGUGAAGCACCUCCG | 1496 | CGGAGGUGCUUCACUGUCAUUUC | Rat | [480-502] ORF |
| 515 | 1114 | GGAAAUGACAGUGAAGCACCUCC | 1497 | GGAGGUGCUUCACUGUCAUUUCC | Rat | [479-501] ORF |
| 516 | 1115 | GAUUUCUUUUUAUGUGAUGCCAA | 1498 | UGGCAUCACAUAAAAAGAAAUC | | [1349-1371] 3'UTR |
| 517 | 1116 | AUUAAGUGGUUACUUUGUGUUAU | 1499 | AAAACACAAAGUAACCACUUAAU | | [1182-1204] 3'UTR |
| 518 | 1117 | AGGUGUUUGGAGGCUUCCAGGUG | 1500 | CACCUGGAAGCCUCCAAACACCU | | [877-899] ORF |
| 519 | 1118 | AAGGUGUUUGGAGGCUUCCAGGU | 1501 | ACCUGGAAGCCUCCAAACACCUU | | [876-898] ORF |

FIGURE 4 Continued

| | | | | | | | |
|---|---|---|---|---|---|---|---|
| 520 | 1119 | UAAGGUGUUUGGAGGCUUCCAGG | 1502 | CCUGGAAGCCUCCAAACACCUUA | | [875-897] ORF |
| 521 | 1120 | CUGAGCCAGCUGAAAACACUGAU | 1503 | AUCAGUGUUUUCAGCUGGCUCAG | Chn | [396-418] ORF |
| 522 | 1121 | UCUGAGCCAGCUGAAAACACUGA | 1504 | UCAGUGUUUUCAGCUGGCUCAGA | Chn | [395-417] ORF |
| 523 | 1122 | GUCUGAGCCAGCUGAAAACACUG | 1505 | CAGUGUUUUCAGCUGGCUCAGAC | Chn | [394-416] ORF |
| 524 | 1123 | GCUCUUAAAAUAUCUUCCUUUGG | 1506 | CCAAAGGAAGAUAUUUUAAGAGC | Rat,Ms | [1387-1409] 3'UTR |
| 525 | 1124 | UGCUCUUAAAAUAUCUUCCUUUG | 1507 | CAAAGGAAGAUAUUUUAAGAGCA | Rat,Ms | [1386-1408] 3'UTR |
| 526 | 1125 | AUGCUCUUAAAAUAUCUUCCUUU | 1508 | AAAGGAAGAUAUUUUAAGAGCAU | Rat,Ms | [1385-1407] 3'UTR |
| 527 | 1126 | AAUGCUCUUAAAAUAUCUUCCUU | 1509 | AAGGAAGAUAUUUUAAGAGCAUU | Rat,Ms | [1384-1406] 3'UTR |
| 528 | 1127 | AAAUGCUCUUAAAAUAUCUUCCU | 1510 | AGGAAGAUAUUUUAAGAGCAUUU | Rat,Ms | [1383-1405] 3'UTR |
| 529 | 1128 | CCGAUGGCCAGUUUGCUUUCCUC | 1511 | GAGGAAAGCAAACUGGCCAUCGG | | [910-932] ORF |
| 530 | 1129 | CCCGAUGGCCAGUUUGCUUUCCU | 1512 | AGGAAAGCAAACUGGCCAUCGGG | | [909-931] ORF |
| 531 | 1130 | UCCCGAUGGCCAGUUUGCUUUCC | 1513 | GGAAAGCAAACUGGCCAUCGGGA | | [908-930] ORF |
| 532 | 1131 | CUCCCGAUGGCCAGUUUGCUUUC | 1514 | GAAAGCAAACUGGCCAUCGGGAG | | [907-929] ORF |
| 533 | 1132 | GCUCCCGAUGGCCAGUUUGCUUU | 1515 | AAAGCAAACUGGCCAUCGGGAGC | | [906-928] ORF |
| 534 | 1133 | GUUAAUACCGAGGUGCGCACUCG | 1516 | CGAGUGCGCACCUCGGUAUUAAC | | [627-649] ORF |
| 535 | 1134 | CGUUAAUACCGAGGUGCGCACUC | 1517 | GAGUGCGCACCUCGGUAUUAACG | | [626-648] ORF |
| 536 | 1135 | GCGUUAAUACCGAGGUGCGCACU | 1518 | AGUGCGCACCUCGGUAUUAACGC | | [625-647] ORF |
| 537 | 1136 | GGCGUUAAUACCGAGGUGCGCAC | 1519 | GUGCGCACCUCGGUAUUAACGCC | | [624-646] ORF |
| 538 | 1137 | GGGCGUUAAUACCGAGGUGCGCA | 1520 | UGCGCACCUCGGUAUUAACGCCC | | [623-645] ORF |
| 539 | 1138 | GAUUAAGUGGUUACUUUGUGUUU | 1521 | AAACACAAAGUAACCACUUAAUC | | [1181-1203] 3'UTR |
| 540 | 1139 | UAAAUGAAAGUCUGAGCCAGCUG | 1522 | CAGCUGGCUCAGACUUUCAUUUA | | [385-407] ORF |
| 541 | 1140 | AUAAAUGAAAGUCUGAGCCAGCU | 1523 | AGCUGGCUCAGACUUUCAUUUAU | | [384-406] ORF |
| 542 | 1141 | AAUAAAUGAAAGUCUGAGCCAGC | 1524 | GCUGGCUCAGACUUUCAUUUAUU | | [383-405] ORF |
| 543 | 1142 | GAAUAAAUGAAAGUCUGAGCCAG | 1525 | CUGGCUCAGACUUUCAUUUAUUC | | [382-404] ORF |
| 544 | 1143 | AGAAUAAAUGAAAGUCUGAGCCA | 1526 | UGGCUCAGACUUUCAUUUAUUCU | | [381-403] ORF |
| 545 | 1144 | AAGAAUAAAUGAAAGUCUGAGCC | 1527 | GGCUCAGACUUUCAUUUAUUCUU | | [380-402] ORF |
| 546 | 1145 | CAAGAAUAAAUGAAAGUCUGAGC | 1528 | GCUCAGACUUUCAUUUAUUCUUG | | [379-401] ORF |
| 547 | 1146 | GCAAGAAUAAAUGAAAGUCUGAG | 1529 | CUCAGACUUUCAUUUAUUCUUGC | | [378-400] ORF |
| 548 | 1147 | CAUCUGAGCACAGAAAGUCAUCA | 1530 | UGAUGACUUUCUGUGCUCAGAUG | | [328-350] ORF |
| 549 | 1148 | UGACAUUUCGUUUUUUACACGAG | 1531 | CUCGUGUAAAAAACGAAAUGUCA | Rat,Ms | [1327-1349] 3'UTR |
| 550 | 1149 | AUGACAUUUCGUUUUUUACACGA | 1532 | UCGUGUAAAAAACGAAAUGUCAU | Rat,Ms | [1326-1348] 3'UTR |
| 551 | 1150 | GAUGACAUUUCGUUUUUUACACG | 1533 | CGUGUAAAAAACGAAAUGUCAUC | Rat,Ms | [1325-1347] 3'UTR |
| 552 | 1151 | AGAUGACAUUUCGUUUUUUACAC | 1534 | GUGUAAAAAACGAAAUGUCAUCU | Rat,Ms | [1324-1346] 3'UTR |
| 553 | 1152 | CAGUGUCAACACGACACCGGAUA | 1535 | UAUCCGGUGUCGUGUUGACACUG | Chn | [293-315] ORF |
| 554 | 1153 | CCAGUGUCAACACGACACCGGAU | 1536 | AUCCGGUGUCGUGUUGACACUGG | Chn | [292-314] ORF |
| 555 | 1154 | CGUUUUUUACACGAGAUUUCUUU | 1537 | AAAGAAAUCUCGUGUAAAAAACG | Rat,Ms | [1335-1357] 3'UTR |
| 556 | 1155 | UCGUUUUUUACACGAGAUUUCUU | 1538 | AAGAAAUCUCGUGUAAAAAACGA | Rat,Ms | [1334-1356] 3'UTR |
| 557 | 1156 | UUCGUUUUUUACACGAGAUUUCU | 1539 | AGAAAUCUCGUGUAAAAAACGAA | Rat,Ms | [1333-1355] 3'UTR |
| 558 | 1157 | AUGUUCAUAUUGGAUUGCGCCUU | 1540 | AAGGCGCAAUCCAAUAUGAACAU | Rat,Ms | [1285-1307] 3'UTR |
| 559 | 1158 | UAUGUUCAUAUUGGAUUGCGCCU | 1541 | AGGCGCAAUCCAAUAUGAACAUA | Rat,Ms | [1284-1306] 3'UTR |
| 560 | 1159 | AUAUGUUCAUAUUGGAUUGCGCC | 1542 | GGCGCAAUCCAAUAUGAACAUAU | Rat,Ms | [1283-1305] 3'UTR |
| 561 | 1160 | UAUAUGUUCAUAUUGGAUUGCGC | 1543 | GCGCAAUCCAAUAUGAACAUAUA | Rat,Ms | [1282-1304] 3'UTR |
| 562 | 1161 | UGAUUAAGUGGUUACUUUGUGUU | 1544 | AACACAAAGUAACCACUUAAUCA | GP | [1180-1202] 3'UTR |
| 563 | 1162 | UUGAUUAAGUGGUUACUUUGUGU | 1545 | ACACAAAGUAACCACUUAAUCAA | GP | [1179-1201] 3'UTR |
| 564 | 1163 | UUUGAUUAAGUGGUUACUUUGUG | 1546 | CACAAAGUAACCACUUAAUCAAA | GP | [1178-1200] 3'UTR |
| 565 | 1164 | UUUUGAUUAAGUGGUUACUUUGU | 1547 | ACAAAGUAACCACUUAAUCAAAA | GP | [1177-1199] 3'UTR |
| 566 | 1165 | UUUUUGAUUAAGUGGUUACUUUG | 1548 | CAAAGUAACCACUUAAUCAAAAA | GP | [1176-1198] 3'UTR |
| 567 | 1166 | GCUACGAUCACCAAGUAGCCAC | 1549 | GUGGCUACUUGGUGAUCAGUAGC | | [76-98] 5'UTR |
| 568 | 1167 | GUGCUGAUAACAGCGGAAUCCCC | 1550 | GGGGAUUCCGCUGUUAUCAGCAC | Ms | [22-44] 5'UTR |
| 569 | 1168 | AUUCUUUUUCGUGAAGAACUCCA | 1551 | UGGAGUUCUUCACGAAAAAGAAU | | [172-194] 5'UTR |
| 570 | 1169 | AAUUCUUUUUCGUGAAGAACUCC | 1552 | GGAGUUCUUCACGAAAAAGAAUU | | [171-193] 5'UTR |
| 571 | 1170 | AAAUUCUUUUUCGUGAAGAACUC | 1553 | GAGUUCUUCACGAAAAAGAAUUU | | [170-192] 5'UTR |
| 572 | 1171 | UGUUUGGAGGCUUCCAGGUGGUA | 1554 | UACCACCUGGAAGCCUCCAAACA | | [880-902] ORF |
| 573 | 1172 | GUGUUUGGAGGCUUCCAGGUGGU | 1555 | ACCACCUGGAAGCCUCCAAACAC | | [879-901] ORF |
| 574 | 1173 | GGUGUUUGGAGGCUUCCAGGUGG | 1556 | CCACCUGGAAGCCUCCAAACACC | | [878-900] ORF |
| 575 | 1174 | UUACUUUUUGUAGAGAGCGUGU | 1557 | ACAGCUCUCUACAAAAAGUAA | | [1221-1243] 3'UTR |
| 576 | 1175 | GCUCUGAAGAAAGAUAGCUCGCG | 1558 | CGCGAGCUAUCUUUCUUCAGAGC | | [426-448] ORF |
| 577 | 1176 | UGCUCUGAAGAAAGAUAGCUCGC | 1559 | GCGAGCUAUCUUUCUUCAGAGCA | | [425-447] ORF |
| 578 | 1177 | AUGCUCUGAAGAAAGAUAGCUCG | 1560 | CGAGCUAUCUUUCUUCAGAGCAU | | [424-446] ORF |
| 579 | 1178 | AAAUUUACACGAGAUUUCUUUUU | 1561 | AAAAGAAAUCUCGUGUAAAAAAC | Rat,Ms | [1336-1358] 3'UTR |
| 580 | 1179 | UAAACCCUCAGCACUUGCUCAGU | 1562 | ACUGAGCAAGUGCUGAGGGUUUA | | [108-130] 5'UTR |
| 581 | 1180 | AAUUAAACCCUCAGCACUUGCUCA | 1563 | UGAGCAAGUGCUGAGGGUUUAUU | | [106-128] 5'UTR |
| 582 | 1181 | UGUAUUAUAAAAGCUCAGAUGAC | 1564 | GUCAUCUGAGCUUUUAUAAUACA | | [1308-1330] 3'UTR |
| 583 | 1182 | UGCUUUCCUCAUUCCCAACGGGG | 1565 | CCCCGUUGGGAAUGAGGAAAGCA | | [923-945] ORF |
| 584 | 1183 | GACUUUUUUGAUUAAGUGGUUAC | 1566 | GUAACCACUUAAUCAAAAAAGUC | | [1172-1194] 3'UTR |
| 585 | 1184 | GGCGGCUAAGGUGUUUGGAGGCU | 1567 | AGCCUCCAAACACCUUAGCCGCC | | [869-891] ORF |
| 586 | 1185 | AGGGCGUUAAUACCGAGGUGCGC | 1568 | GCGCACCUCGGUAUUAACGCCCU | | [622-644] ORF |
| 587 | 1186 | GAGGGCGUUAAUACCGAGGUGCG | 1569 | CGCACCUCGGUAUUAACGCCCUC | | [621-643] ORF |

FIGURE 4 Continued

| | | | | | | |
|---|---|---|---|---|---|---|
| 588 | 1187 | CGAGGGCGUUAAUACCGAGGUGC | 1570 | GCACCUCGGUAUUAACGCCCUCG | | [620-642] ORF |
| 589 | 1188 | GCGAGGGCGUUAAUACCGAGGUG | 1571 | CACCUCGGUAUUAACGCCCUCGC | | [619-641] ORF |
| 590 | 1189 | UGCGAGGGCGUUAAUACCGAGGU | 1572 | ACCUCGGUAUUAACGCCCUCGCA | | [618-640] ORF |
| 591 | 1190 | UGAGCACAGACCCAAGUGUGCUG | 1573 | CAGCACACUUGGGUCUGUGCUCA | | [535-557] ORF |
| 592 | 1191 | CUGAGCACAGACCCAAGUGUGCU | 1574 | AGCACACUUGGGUCUGUGCUCAG | | [534-556] ORF |
| 593 | 1192 | GCUGAGCACAGACCCAAGUGUGC | 1575 | GCACACUUGGGUCUGUGCUCAGC | | [533-555] ORF |
| 594 | 1193 | CGCUGAGCACAGACCCAAGUGUG | 1576 | CACACUUGGGUCUGUGCUCAGCG | | [532-554] ORF |
| 595 | 1194 | GCGCUGAGCACAGACCCAAGUGU | 1577 | ACACUUGGGUCUGUGCUCAGCGC | | [531-553] ORF |
| 596 | 1195 | GGAGAAAAAUUCCUCGUCCCCGG | 1578 | CCGGGGACGAGGAAUUUUUCUCC | Rat,Chn | [254-276] ORF |
| 597 | 1196 | UGGAGAAAAAUUCCUCGUCCCCG | 1579 | CGGGGACGAGGAAUUUUUCUCCA | Rat,Chn | [253-275] ORF |
| 598 | 1197 | AUGGAGAAAAAUUCCUCGUCCCC | 1580 | GGGGACGAGGAAUUUUUCUCCAU | Rat,Chn | [252-274] ORF |
| 599 | 1198 | AAUGGAGAAAAAUUCCUCGUCCC | 1581 | GGGACGAGGAAUUUUUCUCCAUU | Rat,Chn | [251-273] ORF |
| 600 | 1199 | UAAUGGAGAAAAAUUCCUCGUCC | 1582 | GGACGAGGAAUUUUUCUCCAUUA | Rat,Chn | [250-272] ORF |
| 601 | 1200 | GCAUUCCAAGCUGGAGAAGGCGG | 1583 | CCGCCUUCUCCAGCUUGGAAUGC | Rat,GP,Chn | [449-471] ORF |
| 602 | 1201 | GCCUUUGUAUUAUAAAAGCUCAG | 1584 | CUGAGCUUUUAUAAUACAAAGGC | | [1303-1325] 3'UTR |
| 603 | 1202 | ACCUCUCUCCUUGGUCCUGGAAC | 1585 | GUUCCAGGACCAAGGAGAGAGGU | Rat,Ms | [50-72] 5'UTR |
| 604 | 1203 | UACCUCUCUCCUUGGUCCUGGAA | 1586 | UUCCAGGACCAAGGAGAGAGGUA | Rat,Ms | [49-71] 5'UTR |
| 605 | 1204 | GAUCAAUGCCAUGACCUACCCCG | 1587 | CGGGGUAGGUCAUGGCAUUGAUC | | [683-705] ORF |
| 606 | 1205 | AGCAAGAAUAAAUGAAAGUCUGA | 1588 | UCAGACUUUCAUUUAUUCUUGCU | Ms | [377-399] ORF |
| 607 | 1206 | UGCUGAUAACAGCGGAAUCCCCC | 1589 | GGGGGAUUCCGCUGUUAUCAGCA | Ms | [23-45] 5'UTR |
| 608 | 1207 | GAGAAAAAUUCCUCGUCCCCGGU | 1590 | ACCGGGGACGAGGAAUUUUUCUC | Rat,Chn | [255-277] ORF |
| 609 | 1208 | UAAAAUAUCUUCCUUUGGGGAAG | 1591 | CUUCCCCAAAGGAAGAUAUUUUA | Rat,Ms | [1392-1414] 3'UTR |
| 610 | 1209 | UUAAAAUAUCUUCCUUUGGGGAA | 1592 | UUCCCCAAAGGAAGAUAUUUUAA | Rat,Ms | [1391-1413] 3'UTR |
| 611 | 1210 | CUUAAAAUAUCUUCCUUUGGGGA | 1593 | UCCCCAAAGGAAGAUAUUUUAAG | Rat,Ms | [1390-1412] 3'UTR |
| 612 | 1211 | UCUUAAAAUAUCUUCCUUUGGGG | 1594 | CCCCAAAGGAAGAUAUUUUAAGA | Rat,Ms | [1389-1411] 3'UTR |
| 613 | 1212 | CUCUUAAAAUAUCUUCCUUUGGG | 1595 | CCCAAAGGAAGAUAUUUUAAGAG | Rat,Ms | [1388-1410] 3'UTR |
| 614 | 1213 | CAUUCCAAGCUGGAGAAGGCGGA | 1596 | UCCGCCUUCUCCAGCUUGGAAUG | Rat,GP,Chn | [450-472] ORF |
| 615 | 1214 | AUAAUGGAGAAAAAUUCCUCGUC | 1597 | GACGAGGAAUUUUUCUCCAUUAU | Rat,Chn | [249-271] ORF |
| 616 | 1215 | UAUAAUGGAGAAAAAUUCCUCGU | 1598 | ACGAGGAAUUUUUCUCCAUUAUA | Rat,Chn | [248-270] ORF |
| 617 | 1216 | GUCUACCUCUCUCCUUGGUCCUG | 1599 | CAGGACCAAGGAGAGAGGUAGAC | Rat,Ms | [46-68] 5'UTR |
| 618 | 1217 | CGUCUACCUCUCUCCUUGGUCCU | 1600 | AGGACCAAGGAGAGAGGUAGACG | Rat,Ms | [45-67] 5'UTR |
| 619 | 1218 | CCGUCUACCUCUCUCCUUGGUCC | 1601 | GGACCAAGGAGAGAGGUAGACGG | Rat,Ms | [44-66] 5'UTR |
| 620 | 1219 | CCCGUCUACCUCUCUCCUUGGUC | 1602 | GACCAAGGAGAGAGGUAGACGGG | Rat,Ms | [43-65] 5'UTR |
| 621 | 1220 | CCCCGUCUACCUCUCUCCUUGGU | 1603 | ACCAAGGAGAGAGGUAGACGGGG | Rat,Ms | [42-64] 5'UTR |
| 622 | 1221 | AAAAUGCUCUUAAAAUAUCUUCC | 1604 | GGAAGAUAUUUUAAGAGCAUUUU | Rat,Ms | [1382-1404] 3'UTR |
| 623 | 1222 | UCAAUGCCAUGACCUACCCCGGG | 1605 | CCCGGGGUAGGUCAUGGCAUUGA | | [685-707] ORF |
| 624 | 1223 | AUCAAUGCCAUGACCUACCCCGG | 1606 | CCGGGGUAGGUCAUGGCAUUGAU | | [684-706] ORF |
| 625 | 1224 | AUUCCAAGCUGGAGAAGGCGGAC | 1607 | GUCCGCCUUCUCCAGCUUGGAAU | Rat,GP,Chn | [451-473] ORF |
| 626 | 1225 | AUAUAAUGGAGAAAAAUUCCUCG | 1608 | CGAGGAAUUUUUCUCCAUUAUAU | Rat,Chn | [247-269] ORF |
| 627 | 1226 | AAAAUUCUUUUUCGUGAAGAACU | 1609 | AGUUCUUCACGAAAAAGAAUUUU | | [169-191] 5'UTR |
| 628 | 1227 | ACAAAAUAUAAAUAAACCCUCAGC | 1610 | GCUGAGGGUUUAUUUAUAUUUUGU | | [97-119] 5'UTR |
| 629 | 1228 | CUUUCCUCAUUCCCAACGGGGCC | 1611 | GGCCCCGUUGGGAAUGAGGAAAG | | [925-947] ORF |
| 630 | 1229 | GCUUUCCUCAUUCCCAACGGGGC | 1612 | GCCCCGUUGGGAAUGAGGAAAGC | | [924-946] ORF |
| 631 | 1230 | GAUAUAAUGGAGAAAAAUUCCUC | 1613 | GAGGAAUUUUUCUCCAUUAUAUC | Rat,Ms,Chn | [246-268] ORF |
| 632 | 1231 | GCUGAUAACAGCGGAAUCCCCCG | 1614 | CGGGGGAUUCCGCUGUUAUCAGC | Ms | [24-46] 5'UTR |
| 633 | 1232 | UUAAUACCGAGGUGCGCACUCGG | 1615 | CCGAGUGCGCACCUCGGUAUUAA | | [628-650] ORF |
| 634 | 1233 | CUGAUAACAGCGGAAUCCCCCGU | 1616 | ACGGGGGAUUCCGCUGUUAUCAG | Ms | [25-47] 5'UTR |
| 635 | 1234 | UAAUACCGAGGUGCGCACUCGGC | 1617 | GCCGAGUGCGCACCUCGGUAUUA | | [629-651] ORF |
| 636 | 1235 | AAAAAUUCUUUUUCGUGAAGAAC | 1618 | GUUCUUCACGAAAAAGAAUUUU | | [168-190] 5'UTR |
| 637 | 1236 | UUUCCUCAUUCCCAACGGGGCCU | 1619 | AGGCCCCGUUGGGAAUGAGGAAA | | [926-948] ORF |
| 638 | 1237 | CUACCUCUCUCCUUGGUCCUGGA | 1620 | UCCAGGACCAAGGAGAGAGGUAG | Rat,Ms | [48-70] 5'UTR |
| 639 | 1238 | UCUACCUCUCUCCUUGGUCCUGG | 1621 | CCAGGACCAAGGAGAGAGGUAGA | Rat,Ms | [47-69] 5'UTR |
| 640 | 1239 | UUAUAUGUUCUAUUGGAUUGCG | 1622 | CGCAAUCCAAUAUGAACAUAUAA | Rat,Ms | [1281-1303] 3'UTR |
| 641 | 1240 | AUGACAGUGAAGCACCUCCGGAA | 1623 | UUCCGGAGGUGCUUCACUGUCAU | Rat,GP,Chn | [483-505] ORF |
| 642 | 1241 | AAUGACAGUGAAGCACCUCCGGA | 1624 | UCCGGAGGUGCUUCACUGUCAUU | Rat,GP,Chn | [482-504] ORF |
| 643 | 1242 | AGAUUUCUUUUUUAUGUGAUGCC | 1625 | GGCAUCACAUAAAAAAGAAAUCU | | [1348-1370] 3'UTR |
| 644 | 1243 | UUUUAUAUGUUCUAUUGGAUUGC | 1626 | GCAAUCCAAUAGAACAUAUAAA | Rat,Ms | [1280-1302] 3'UTR |

Table A2 HES5 - hairy and enhancer of split 5

| No. | SEQ ID NO. | Sense siRNA | SEQ ID NO. | AntiSense siRNA | Other Sp | Human-145301612 ORF:82-582 |
|---|---|---|---|---|---|---|
| 1 | 1627 | CCUCCACUAUGAUCCUUAA | 1884 | UUAAGGAUCAUAGUGGAGG | | [1160-1178] 3'UTR |
| 2 | 1628 | GCUGUAUCCUCAUAGGAAA | 1885 | UUUCCUAUGAGGAUACAGC | | [1027-1045] 3'UTR |
| 3 | 1629 | CCGAAGCCGCCAUAAUAAA | 1886 | UUUAUUAUGGCGGCUUCGG | | [1267-1285] 3'UTR |
| 4 | 1630 | CCGCCAUAAUAAAAUCUGA | 1887 | UCAGAUUUUAUUAUGGCGG | | [1273-1291] 3'UTR |
| 5 | 1631 | CGAAGCCGCCAUAAUAAAA | 1888 | UUUUAUUAUGGCGGCUUCG | | [1268-1286] 3'UTR |
| 6 | 1632 | CAGAGUCCCUGCCGUUUUA | 1889 | UAAAACGGCAGGGACUCUG | | [760-778] 3'UTR |

FIGURE 4 Continued

| # | ID | Sequence 1 | ID2 | Sequence 2 | Species | Location |
|---|------|---------------------|------|---------------------|----------|---------------------|
| 7 | 1633 | AGAUGAAGCUGCUGUACCA | 1890 | UGGUACAGCAGCUUCAUCU | | [416-434] ORF |
| 8 | 1634 | CUACCUGAAGCACAGCAAA | 1891 | UUUGCUGUGCUUCAGGUAG | Rat,GP | [282-300] ORF |
| 9 | 1635 | ACGACUUUGUACUCAGAAA | 1892 | UUUCUGAGUACAAAGUCGU | | [1212-1230] 3'UTR |
| 10 | 1636 | GGUUGUUCUGUGUUUGCAU | 1893 | AUGCAAACACAGAACAACC | GP | [822-840] 3'UTR |
| 11 | 1637 | CUCCGAAGCCGCCAUAAUA | 1894 | UAUUAUGGCGGCUUCGGAG | | [1265-1283] 3'UTR |
| 12 | 1638 | CCAACUCCAAGCUGGAGAA | 1895 | UUCCUCCAGCUUGGAGUUGG | Ms,GP,Chn | [236-254] ORF |
| 13 | 1639 | AGAAAAACCGACUGCGGAA | 1896 | UUCCGCAGUCGGUUUUUCU | Ms | [125-143] ORF |
| 14 | 1640 | CGCAGAUGAAGCUGCUGUA | 1897 | UACAGCAGCUUCAUCUGCG | | [413-431] ORF |
| 15 | 1641 | CUUUGUACUCAGAAAUUGA | 1898 | UCAAUUUCUGAGUACAAAG | | [1216-1234] 3'UTR |
| 16 | 1642 | GUUCUGUGUUUGCAUUUAA | 1899 | UUAAAUGCAAACACAGAAC | | [826-844] 3'UTR |
| 17 | 1643 | CAGAGAAUGUGUGUGCAGA | 1900 | UCUGCACACACAUUCUCUG | | [745-763] 3'UTR |
| 18 | 1644 | GCACGACUUUGUACUCAGA | 1901 | UCUGAGUACAAAGUCGUGC | | [1210-1228] 3'UTR |
| 19 | 1645 | GGUUCUAUGAUAUUUGUAG | 1902 | CUACAAAUAUCAUAGAACC | Ms,GP,Chn | [879-897] 3'UTR |
| 20 | 1646 | GCUACCUGAAGCACAGCAA | 1903 | UUGCUGUGCUUCAGGUAGC | Rat,GP,Chn | [281-299] ORF |
| 21 | 1647 | AACUCUCAGUCACGUGGAA | 1904 | UUCCACGUGACUGAGAGUU | | [1234-1252] 3'UTR |
| 22 | 1648 | CGACUUUGUACUCAGAAAU | 1905 | AUUUCUGAGUACAAAGUCG | | [1213-1231] 3'UTR |
| 23 | 1649 | CCAAAAGGCUCCUGAGUGU | 1906 | ACACUCAGGAGCCUUUUGG | | [1090-1108] 3'UTR |
| 24 | 1650 | CAAUCAGGGCCCAUCUUCU | 1907 | AGAAGAUGGGCCCUGAUUG | | [782-800] 3'UTR |
| 25 | 1651 | CGCCAUAAUAAAAUCUGAU | 1908 | AUCAGAUUUUAUUAUGGCG | | [1274-1292] 3'UTR |
| 26 | 1652 | GGGUUCUAUGAUAUUUGUA | 1909 | UACAAAUAUCAUAGAACCC | Ms,GP,Chn | [878-896] 3'UTR |
| 27 | 1653 | UGGAGAUGGCUGUCAGCUA | 1910 | UAGCUGACAGCCAUCUCCA | | [266-284] ORF |
| 28 | 1654 | CACGACUUUGUACUCAGAA | 1911 | UUCUGAGUACAAAGUCGUG | | [1211-1229] 3'UTR |
| 29 | 1655 | CCUCAUAGGAAACAGUGAU | 1912 | AUCACUGUUUCCUAUGAGG | | [1034-1052] 3'UTR |
| 30 | 1656 | GGGUUGUUCUGUGUUUGCA | 1913 | UGCAAACACAGAACAACCC | GP | [821-839] 3'UTR |
| 31 | 1657 | GUGUGGGCACGACUUUGUA | 1914 | UACAAAGUCGUGCCCACAC | | [1204-1222] 3'UTR |
| 32 | 1658 | GAAGCCGCCAUAAUAAAAU | 1915 | AUUUUAUUAUGGCGGCUUC | | [1269-1287] 3'UTR |
| 33 | 1659 | CUCCACUAUGAUCCUUAAA | 1916 | UUUAAGGAUCAUAGUGGAG | | [1161-1179] 3'UTR |
| 34 | 1660 | GAGAAAAACCGACUGCGGA | 1917 | UCCGCAGUCGGUUUUUCUC | Ms | [124-142] ORF |
| 35 | 1661 | CUCAGAAAUUGAACUCUCA | 1918 | UGAGAGUUCAAUUUCUGAG | | [1223-1241] 3'UTR |
| 36 | 1662 | CUAUGAUCCUUAAAGGAUU | 1919 | AAUCCUUUAAGGAUCAUAG | | [1166-1184] 3'UTR |
| 37 | 1663 | AGCUGUAUCCUCAUAGGAA | 1920 | UUCCUAUGAGGAUACAGCU | | [1026-1044] 3'UTR |
| 38 | 1664 | GCAUCAACAGCAGCAUCGA | 1921 | UCGAUGCUGCUGUUGAUGC | GP,Chn | [173-191] ORF |
| 39 | 1665 | CCCUGCCGUUUUAGGACAA | 1922 | UUGUCCUAAAACGGCAGGG | | [766-784] 3'UTR |
| 40 | 1666 | GCCUUUUGUGAAGGCCGAA | 1923 | UUCGGCCUUCACAAAAGGC | | [1003-1021] 3'UTR |
| 41 | 1667 | CUAUGAUAUUUGUAGUGCC | 1924 | GGCACUACAAAUAUCAUAG | | [883-901] 3'UTR |
| 42 | 1668 | AGGACUACAGCGAAGGCUA | 1925 | UAGCCUUCGCUGUAGUCCU | | [338-356] ORF |
| 43 | 1669 | UCCGAAGCCGCCAUAAUAA | 1926 | UUAUUAUGGCGGCUUCGGA | | [1266-1284] 3'UTR |
| 44 | 1670 | GCCUCCACUAUGAUCCUUA | 1927 | UAAGGAUCAUAGUGGAGGC | | [1159-1177] 3'UTR |
| 45 | 1671 | GAACUCUCAGUCACGUGGA | 1928 | UCCACGUGACUGAGAGUUC | | [1233-1251] 3'UTR |
| 46 | 1672 | GCACAUUUGCCUUUUGUGA | 1929 | UCACAAAAGGCAAAUGUGC | Ms | [995-1013] 3'UTR |
| 47 | 1673 | AGCAAGUGACUUCUGGGAA | 1930 | UUCCCAGAAGUCACUUGCU | GP,Chn | [844-862] 3'UTR |
| 48 | 1674 | CGUCAGCUACCUGAAGCA | 1931 | UGCUUCAGGUAGCUGACAG | | [275-293] ORF |
| 49 | 1675 | UGGCUGUCAGCUACCUGAA | 1932 | UUCAGGUAGCUGACAGCCA | | [272-290] ORF |
| 50 | 1676 | CACAUUUGCCUUUUGUGAA | 1933 | UUCACAAAAGGCAAAUGUG | Ms | [996-1014] 3'UTR |
| 51 | 1677 | GCCGUUUUAGGACAAUCGA | 1934 | CUGAUUGUCCUAAAACGGC | | [770-788] 3'UTR |
| 52 | 1678 | CUCAGAGAAUGUGUGUGCA | 1935 | UGCACACACAUUCUCUGAG | | [743-761] 3'UTR |
| 53 | 1679 | GACUUUGUACUCAGAAAUU | 1936 | AAUUUCUGAGUACAAAGUC | | [1214-1232] 3'UTR |
| 54 | 1680 | CACUAUGAUCCUUAAAGGA | 1937 | UCCUUUAAGGAUCAUAGUG | | [1164-1182] 3'UTR |
| 55 | 1681 | UUGUGAAGGCCGAACUCGA | 1938 | UCGAGUUCGGCCUUCACAA | | [1008-1026] 3'UTR |
| 56 | 1682 | AGCUGCUGUACCACUUCCA | 1939 | UGGAAGUGGUACAGCAGCU | | [422-440] ORF |
| 57 | 1683 | GCAAGUGACUUCUGGGAAG | 1940 | CUUCCCAGAAGUCACUUGC | GP,Chn | [845-863] 3'UTR |
| 58 | 1684 | UGUUCUGUGUUUGCAUUUA | 1941 | UAAAAUGCAAACACAGAAC | | [825-843] 3'UTR |
| 59 | 1685 | CCAAAGAGAAAAACCGACU | 1942 | AGUCGGUUUUUCUCUUUGG | | [119-137] ORF |
| 60 | 1686 | CCGUUUUAGGACAAUCAGG | 1943 | CCUGAUUGUCCUAAAACGG | | [771-789] 3'UTR |
| 61 | 1687 | AGAGAAUGUGUGUGCAGAG | 1944 | CUCUGCACACACAUUCUCU | Ms | [746-764] 3'UTR |
| 62 | 1688 | UCAGCUACCUGAAGCACAG | 1945 | CUGUGCUUCAGGUAGCUGA | Rat | [278-296] ORF |
| 63 | 1689 | CUCGAGCUGUAUCCUCAUA | 1946 | UAUGAGGAUACAGCUCGAG | | [1022-1040] 3'UTR |
| 64 | 1690 | GUUGUUCUGUGUUUGCAUU | 1947 | AAUGCAAACACAGAACAAC | GP | [823-841] 3'UTR |
| 65 | 1691 | GAGAAUGUGUGUGCAGAGU | 1948 | ACUCUGCACACACAUUCUC | Ms | [747-765] 3'UTR |
| 66 | 1692 | UGCCUUUUGUGAAGGCCGA | 1949 | UCGGCCUUCACAAAAGGCA | | [1002-1020] 3'UTR |
| 67 | 1693 | GAAUGUGUGUGCAGAGUCC | 1950 | GGACUCUGCACACACAUUC | | [749-767] 3'UTR |
| 68 | 1694 | AUGGCUGUCAGCUACCUGA | 1951 | UCAGGUAGCUGACAGCCAU | | [271-289] ORF |
| 69 | 1695 | CAUAGGAAACAGUGAUCAC | 1952 | GUGAUCACUGUUUCCUAUG | | [1037-1055] 3'UTR |
| 70 | 1696 | GGGCACGACUUUGUACUCA | 1953 | UGAGUACAAAGUCGUGCCC | | [1208-1226] 3'UTR |
| 71 | 1697 | CGAGCUGUAUCCUCAUAGG | 1954 | CCUAUGAGGAUACAGCUCG | | [1024-1042] 3'UTR |
| 72 | 1698 | ACUCGAGCUGUAUCCUCAU | 1955 | AUGAGGAUACAGCUCGAGU | | [1021-1039] 3'UTR |
| 73 | 1699 | CUGUGUUUGCAUUUAAGCA | 1956 | UGCUUAAAUGCAAACACAG | | [829-847] 3'UTR |
| 74 | 1700 | GAAAUUGAACUCUCAGUCA | 1957 | UGACUGAGAGUUCAAUUUC | | [1227-1245] 3'UTR |

FIGURE 4 Continued

| | | | | | | |
|---|---|---|---|---|---|---|
| 75 | 1701 | GAGCUGUAUCCUCAUAGGA | 1958 | UCCUAUGAGGAUACAGCUC | | [1025-1043] 3'UTR |
| 76 | 1702 | CGGGCACAUUUGCCUUUUG | 1959 | CAAAAGGCAAAUGUGCCCG | | [992-1010] 3'UTR |
| 77 | 1703 | CCCAAAGAGAAAAACCGAC | 1960 | GUCGGUUUUUCUCUUUGGG | | [118-136] ORF |
| 78 | 1704 | UCCUCAUAGGAAACAGUGA | 1961 | UCACUGUUUCCUAUGAGGA | | [1033-1051] 3'UTR |
| 79 | 1705 | AAGCAAGUGACUUCUGGGA | 1962 | UCCCAGAAGUCACUUGCUU | | [843-861] 3'UTR |
| 80 | 1706 | UGUGUUUGCAUUUAAGCAA | 1963 | UUGCUUAAAUGCAAACACA | | [830-848] 3'UTR |
| 81 | 1707 | CAUCUUCUGCCAAGUGUCU | 1964 | AGACACUUGGCAGAAGAUG | | [793-811] 3'UTR |
| 82 | 1708 | GGCACGACUUUGUACUCAG | 1965 | CUGAGUACAAAGUCGUGCC | | [1209-1227] 3'UTR |
| 83 | 1709 | GGGCACAUUUGCCUUUUGU | 1966 | ACAAAAGGCAAAUGUGCCC | Ms | [993-1011] 3'UTR |
| 84 | 1710 | UUCUGUGUUUGCAUUUAAG | 1967 | CUUAAAUGCAAACACAGAA | | [827-845] 3'UTR |
| 85 | 1711 | UCUUCUGCCAAGUGUCUGA | 1968 | UCAGACACUUGGCAGAAGA | | [795-813] 3'UTR |
| 86 | 1712 | ACAUUUGCCUUUUGUGAAG | 1969 | CUUCACAAAAGGCAAAUGU | Ms | [997-1015] 3'UTR |
| 87 | 1713 | UCAACAGCAGCAUCGAGCA | 1970 | UGCUCGAUGCUGCUGUUGA | Chn | [176-194] ORF |
| 88 | 1714 | CGUUUUAGGACAAUCAGGG | 1971 | CCCUGAUUGUCCUAAAACG | | [772-790] 3'UTR |
| 89 | 1715 | CCACUAUGAUCCUUAAAGG | 1972 | CCUUUAAGGAUCAUAGUGG | | [1163-1181] 3'UTR |
| 90 | 1716 | UGCCGUUUUAGGACAAUCA | 1973 | UGAUUGUCCUAAAACGGCA | | [769-787] 3'UTR |
| 91 | 1717 | GUCAGCUACCUGAAGCACA | 1974 | UGUGCUUCAGGUAGCUGAC | Rat | [277-295] ORF |
| 92 | 1718 | AACUCGAGCUGUAUCCUCA | 1975 | UGAGGAUACAGCUCGAGUU | | [1020-1038] 3'UTR |
| 93 | 1719 | GCGGGCACAUUUGCCUUUU | 1976 | AAAAGGCAAAUGUGCCCGC | | [991-1009] 3'UTR |
| 94 | 1720 | ACCUGUAGAGGACUUUCUU | 1977 | AAGAAAGUCCUCUACAGGU | | [926-944] 3'UTR |
| 95 | 1721 | CCUGCCGUUUUAGGACAAU | 1978 | AUUGUCCUAAAACGGCAGG | | [767-785] 3'UTR |
| 96 | 1722 | AGUCCUGCCGUUUUAGGA | 1979 | UCCUAAAACGGCAGGGACU | | [763-781] 3'UTR |
| 97 | 1723 | CUGUAGAGGACUUUCUUCA | 1980 | UGAAGAAAGUCCUCUACAG | GP | [928-946] 3'UTR |
| 98 | 1724 | CAGAAAUUGAACUCUCAGU | 1981 | ACUGAGAGUUCAAUUUCUG | | [1225-1243] 3'UTR |
| 99 | 1725 | CCUUAAAGGAUUCCUCUGU | 1982 | ACAGAGGAAUCCUUUAAGG | | [1173-1191] 3'UTR |
| 100 | 1726 | CAAAGAGAAAAACCGACUG | 1983 | CAGUCGGUUUUUCUCUUUG | | [120-138] ORF |
| 101 | 1727 | CUUUUGUGAAGGCCGAACU | 1984 | AGUUCGGCCUUCACAAAAG | | [1005-1023] 3'UTR |
| 102 | 1728 | CCAUUCUCAGAGAAUGUGA | 1985 | ACACAUUCUCUGAGAAUGG | | [738-756] 3'UTR |
| 103 | 1729 | UGAAGCUGCUGUACCACUU | 1986 | AAGUGGUACAGCAGCUUCA | | [419-437] ORF |
| 104 | 1730 | UGAUAUUUGUAGUGCCGGG | 1987 | CCCGGCACUACAAAUAUCA | | [886-904] 3'UTR |
| 105 | 1731 | UGUUUGCAUUUAAGCAAGU | 1988 | ACUUGCUUAAAUGCAAACA | | [832-850] 3'UTR |
| 106 | 1732 | AUGUGUGUGGCAGAGUCCCU | 1989 | AGGGACUCUGCACACACAU | | [751-769] 3'UTR |
| 107 | 1733 | ACACGCAGAUGAAGCUGCU | 1990 | AGCAGCUUCAUCUGCGUGU | Rat,Ms | [410-428] ORF |
| 108 | 1734 | CCAACCUGUAGAGGACUUU | 1991 | AAAGUCCUCUACAGGUUGG | | [923-941] 3'UTR |
| 109 | 1735 | CCCAACCUGUAGAGGACUU | 1992 | AAGUCCUCUACAGGUUGGG | | [922-940] 3'UTR |
| 110 | 1736 | GACAAUCAGGGCCCAUCUU | 1993 | AAGAUGGGCCCUGAUUGUC | | [780-798] 3'UTR |
| 111 | 1737 | UCAUAGGAAACAGUGAUCA | 1994 | UGAUCACUGUUUCCUAUGA | | [1036-1054] 3'UTR |
| 112 | 1738 | UAUGAUAUUUGUAGUGCCG | 1995 | CGGCACUACAAAUAUCAUA | | [884-902] 3'UTR |
| 113 | 1739 | UGAAGCACAGCAAAGCCUU | 1996 | AAGGCUUUGCUGUGCUUCA | Rat,GP | [287-305] ORF |
| 114 | 1740 | UGGGUGCCUCCACUAUGAU | 1997 | AUCAUAGUGGAGGCACCCA | | [1154-1172] 3'UTR |
| 115 | 1741 | GUGUUUGCAUUUAAGCAAG | 1998 | CUUGCUUAAAUGCAAACAC | | [831-849] 3'UTR |
| 116 | 1742 | CCAUCUUCUGCCAAGUGUC | 1999 | GACACUUGGCAGAAGAUGG | | [792-810] 3'UTR |
| 117 | 1743 | UCAGAAAUUGAACUCUCAG | 2000 | CUGAGAGUUCAAUUUCUGA | | [1224-1242] 3'UTR |
| 118 | 1744 | AUGGCCAAAAGGCUCCUGA | 2001 | UCAGGAGCCUUUUGGCCAU | | [1086-1104] 3'UTR |
| 119 | 1745 | UAUCCUCAUAGGAAACAGU | 2002 | ACUGUUUCCUAUGAGGAUA | | [1031-1049] 3'UTR |
| 120 | 1746 | ACUUUCUUCAGGGCCCGUA | 2003 | UACGGGCCCUGAAGAAAGU | | [937-955] 3'UTR |
| 121 | 1747 | GGCACAUUUGCCUUUUGUG | 2004 | CACAAAAGGCAAAUGUGCC | Ms | [994-1012] 3'UTR |
| 122 | 1748 | CAUCAACAGCAGCAUCGAG | 2005 | CUCGAUGCUGCUGUUGAUG | Chn | [174-192] ORF |
| 123 | 1749 | GCAAUUAAGCAAGUGACUU | 2006 | AAGUCACUUGCUUAAAUGC | | [837-855] 3'UTR |
| 124 | 1750 | UACAGCGAAGGCUACUCGU | 2007 | ACGAGUAGCCUUCGCUGUA | | [343-361] ORF |
| 125 | 1751 | GACUACAGCGAAGGCUACU | 2008 | AGUAGCCUUCGCUGUAGUC | | [340-358] ORF |
| 126 | 1752 | CCCAUCUUCUGCCAAGUGU | 2009 | ACACUUGGCAGAAGAUGGG | | [791-809] 3'UTR |
| 127 | 1753 | AAGCCGCCAUAAUAAAAUC | 2010 | GAUUUUAUUAUGGCGGCUU | | [1270-1288] 3'UTR |
| 128 | 1754 | AGGAUUCCUCUGUGUGGGU | 2011 | ACCCACACAGAGGAAUCCU | | [1179-1197] 3'UTR |
| 129 | 1755 | CUUAAAGGAUUCCUCUGUG | 2012 | CACAGAGGAAUCCUUUAAG | | [1174-1192] 3'UTR |
| 130 | 1756 | UCAGAGAAUGUGUGUGCAG | 2013 | CUGCACACACAUUCUCUGA | | [744-762] 3'UTR |
| 131 | 1757 | UUAGGACAAUCAGGGCCCA | 2014 | UGGGCCCUGAUUGUCCUAA | | [776-794] 3'UTR |
| 132 | 1758 | GAAGCACAGCAAAGCCUUC | 2015 | GAAGGCUUUGCUGUGCUUC | Rat | [288-306] ORF |
| 133 | 1759 | UGUACUCAGAAAUUGAACU | 2016 | AGUUCAAUUUCUGAGUACA | | [1219-1237] 3'UTR |
| 134 | 1760 | CGAACUCGAGCUGUAUCCU | 2017 | AGGAUACAGCUCGAGUUCG | | [1018-1036] 3'UTR |
| 135 | 1761 | AGAGGACUUUCUUCAGGGC | 2018 | GCCCUGAAGAAAGUCCUCU | Ms | [932-950] 3'UTR |
| 136 | 1762 | GUGCCUCCACUAUGAUCCU | 2019 | AGGAUCAUAGUGGAGGCAC | | [1157-1175] 3'UTR |
| 137 | 1763 | UGUAGAGGACUUUCUUCAG | 2020 | CUGAAGAAAGUCCUCUACA | | [929-947] 3'UTR |
| 138 | 1764 | UGCAUUUAAGCAAGUGACU | 2021 | AGUCACUUGCUUAAAUGCA | | [836-854] 3'UTR |
| 139 | 1765 | GAAAAACCGACUGCGGAAG | 2022 | CUUCCGCAGUCGGUUUUUC | Ms | [126-144] ORF |
| 140 | 1766 | CAACCUGUAGAGGACUUUC | 2023 | GAAAGUCCUCUACAGGUUG | | [924-942] 3'UTR |
| 141 | 1767 | CAAGUGACUUCUGGGAAGU | 2024 | ACUUCCCAGAAGUCACUUG | GP,Chn | [846-864] 3'UTR |
| 142 | 1768 | GUUUUAGGACAAUCAGGGC | 2025 | GCCCUGAUUGUCCUAAAAC | | [773-791] 3'UTR |

FIGURE 4 Continued

| | | | | | | | |
|---|---|---|---|---|---|---|---|
| 143 | 1769 | GCCGCCAUAAUAAAAUCUG | 2026 | CAGAUUUUAUUAUGGCGGC | | | [1272-1290] 3'UTR |
| 144 | 1770 | AAUUGAACUCUCAGUCACG | 2027 | CGUGACUGAGAGUUCAAUU | | | [1229-1247] 3'UTR |
| 145 | 1771 | ACCGCAUCAACAGCAGCAU | 2028 | AUGCUGCUGUUGAUGCGGU | Rat,Ms,Chn | | [170-188] ORF |
| 146 | 1772 | UAGGACAAUCAGGGCCCAU | 2029 | AUGGGCCCUGAUUGUCCUA | | | [777-795] 3'UTR |
| 147 | 1773 | UACCUGAAGCACAGCAAAG | 2030 | CUUUGCUGUGCUUCAGGUA | Rat,GP | | [283-301] ORF |
| 148 | 1774 | UUAAAGGAUUCCUCUGUGU | 2031 | ACACAGAGGAAUCCUUUAA | | | [1175-1193] 3'UTR |
| 149 | 1775 | ACAUCCUGGAGAUGGCUGU | 2032 | ACAGCCAUCUCCAGGAUGU | | | [260-278] ORF |
| 150 | 1776 | UCCCUGCCGUUUUAGGACA | 2033 | UGUCCUAAAACGGCAGGGA | | | [765-783] 3'UTR |
| 151 | 1777 | CAUUCUCAGAGAAUGUGUG | 2034 | CACACAUUCUCUGAGAAUG | | | [739-757] 3'UTR |
| 152 | 1778 | AGAUGGCUGUCAGCUACCU | 2035 | AGGUAGCUGACAGCCAUCU | | | [269-287] ORF |
| 153 | 1779 | CAAAAGGCUCCUGAGUGUG | 2036 | CACACUCAGGAGCCUUUUG | | | [1091-1109] 3'UTR |
| 154 | 1780 | GUAGAGGACUUUCUUCAGG | 2037 | CCUGAAGAAAGUCCUCUAC | Ms | | [930-948] 3'UTR |
| 155 | 1781 | CCUGUAGAGGACUUUCUUC | 2038 | GAAGAAAGUCCUCUACAGG | GP | | [927-945] 3'UTR |
| 156 | 1782 | UUUGCAUUUAAGCAAGUGA | 2039 | UCACUUGCUUAAAUGCAAA | | | [834-852] 3'UTR |
| 157 | 1783 | AGAGAAAAACCGACUGCGG | 2040 | CCGCAGUCGGUUUUUCUCU | | | [123-141] ORF |
| 158 | 1784 | GCAGAUGAAGCUGCUGUAC | 2041 | GUACAGCAGCUUCAUCUGC | | | [414-432] ORF |
| 159 | 1785 | AGCACAGCAAAGCCUUCGU | 2042 | ACGAAGGCUUUGCUGUGCU | | | [290-308] ORF |
| 160 | 1786 | ACUUUGUACUCAGAAAUUG | 2043 | CAAUUUCUGAGUACAAAGU | | | [1215-1233] 3'UTR |
| 161 | 1787 | GUGGGCACGACUUUGUACU | 2044 | AGUACAAAGUCGUGCCCAC | | | [1206-1224] 3'UTR |
| 162 | 1788 | GAUCCUUAAAGGAUUCCUC | 2045 | GAGGAAUCCUUUAAGGAUC | | | [1170-1188] 3'UTR |
| 163 | 1789 | UCCACUAUGAUCCUUAAAG | 2046 | CUUUAAGGAUCAUAGUGGA | | | [1162-1180] 3'UTR |
| 164 | 1790 | CUCAUAGGAAACAGUGACC | 2047 | GAUCACUGUUUCCUAUGAG | | | [1035-1053] 3'UTR |
| 165 | 1791 | CUGUAUCCUCAUAGGAAAC | 2048 | GUUUCCUAUGAGGAUACAG | | | [1028-1046] 3'UTR |
| 166 | 1792 | CAGAUGAAGCUGCUGUACC | 2049 | GGUACAGCAGCUUCAUCUG | | | [415-433] ORF |
| 167 | 1793 | ACUAUGAUCCUUAAAGGAU | 2050 | AUCCUUUAAGGAUCAUAGU | | | [1165-1183] 3'UTR |
| 168 | 1794 | GUAUCCUCAUAGGAAACAG | 2051 | CUGUUUCCUAUGAGGAUAC | | | [1030-1048] 3'UTR |
| 169 | 1795 | AACCUGUAGAGGACUUUCU | 2052 | AGAAAGUCCUCUACAGGUU | | | [925-943] 3'UTR |
| 170 | 1796 | AGAGUCCCUGCCGUUUUAG | 2053 | CUAAAACGGCAGGGACUCU | | | [761-779] 3'UTR |
| 171 | 1797 | GAAGCUGCUGUACCACUUC | 2054 | GAAGUGGUACAGCAGCUUC | | | [420-438] ORF |
| 172 | 1798 | ACGCAGAUGAAGCUGCUGU | 2055 | ACAGCAGCUUCAUCUGCGU | | | [412-430] ORF |
| 173 | 1799 | AGCCGCCAUAAUAAAAUCU | 2056 | AGAUUUUAUUAUGGCGGCU | | | [1271-1289] 3'UTR |
| 174 | 1800 | CAACUCCAAGCUGGAGAAG | 2057 | CUUCUCCAGCUUGGAGUUG | Ms,GP,Chn | | [237-255] ORF |
| 175 | 1801 | AGCUACCUGAAGCACAGCA | 2058 | UGCUGUGCUUCAGGUAGCU | Rat,GP,Chn | | [280-298] ORF |
| 176 | 1802 | AUUCCUCUGUGUGGGGUGGA | 2059 | UCCACCCACACAGAGGAAU | | | [1182-1200] 3'UTR |
| 177 | 1803 | UUUUGUGAAGGCCGAACUC | 2060 | GAGUUCGGCCUUCACAAAA | | | [1006-1024] 3'UTR |
| 178 | 1804 | CUGAAGCACAGCAAAGCCU | 2061 | AGGCUUUGCUGUGCUUCAG | Rat,GP | | [286-304] ORF |
| 179 | 1805 | AUUGAACUCUCAGUCACGU | 2062 | ACGUGACUGAGAGUUCAAU | | | [1230-1248] 3'UTR |
| 180 | 1806 | UUGUUCUGUGUUUGCAUUU | 2063 | AAAUGCAAACACAGAACAA | GP | | [824-842] 3'UTR |
| 181 | 1807 | AGAAUGUGUGUGCAGAGUC | 2064 | GACUCUGCACACACAUUCU | | | [748-766] 3'UTR |
| 182 | 1808 | GAUGAAGCUGCUGUACCAC | 2065 | GUGGUACAGCAGCUUCAUC | | | [417-435] ORF |
| 183 | 1809 | UGUGGGCACGACUUUGUAC | 2066 | GUACAAAGUCGUGCCCACA | | | [1205-1223] 3'UTR |
| 184 | 1810 | CAUUUAAGCAAGUGACUUC | 2067 | GAAGUCACUUGCUUAAAUG | | | [838-856] 3'UTR |
| 185 | 1811 | AAAUCUGAUUGUUCAGCCC | 2068 | GGGCUGAACAAUCAGAUUU | | | [1284-1302] 3'UTR |
| 186 | 1812 | AAAUUGAACUCUCAGUCAC | 2069 | GUGACUGAGAGUUCAAUUU | | | [1228-1246] 3'UTR |
| 187 | 1813 | CCUUUUGUGAAGGCCGAAC | 2070 | GUUCGGCCUUCACAAAAGG | | | [1004-1022] 3'UTR |
| 188 | 1814 | ACAACAGGGCCCAUCUGUG | 2071 | GAAGAUGGGCCCUGAUUGU | | | [781-799] 3'UTR |
| 189 | 1815 | CCCAUUCUCAGAGAAUGUG | 2072 | CACAUUCUCUGAGAAUGGG | | | [737-755] 3'UTR |
| 190 | 1816 | AAGAGAAAAACCGACUGCG | 2073 | CGCAGUCGGUUUUUCUCUU | | | [122-140] ORF |
| 191 | 1817 | AAAGGAUUCCUCUGUGUGG | 2074 | CCACACAGAGGAAUCCUUU | | | [1177-1195] 3'UTR |
| 192 | 1818 | AUCCUUAAAGGAUUCCUCU | 2075 | AGAGGAAUCCUUUAAGGAU | | | [1171-1189] 3'UTR |
| 193 | 1819 | UGCCUCCACAUGAUCCUU | 2076 | AAGGAUCAUAGUGGAGGCA | | | [1158-1176] 3'UTR |
| 194 | 1820 | AUGAUAUUUGUAGUGCCGG | 2077 | CCGGCACUACAAAUAUCAU | | | [885-903] 3'UTR |
| 195 | 1821 | AUUUAAGCAAGUGACUUCU | 2078 | AGAAGUCACUUGCUUAAAU | | | [839-857] 3'UTR |
| 196 | 1822 | UUAAGCAAGUGACUUCUGG | 2079 | CCAGAAGUCACUUGCUUAA | | | [841-859] 3'UTR |
| 197 | 1823 | GUUUGCAUUUAAGCAAGUG | 2080 | CACUUGCUUAAAUGCAAAC | | | [833-851] 3'UTR |
| 198 | 1824 | CUGCCGUUUUAGGACAAAC | 2081 | GAUUGUCCUAAAACGGCAG | | | [768-786] 3'UTR |
| 199 | 1825 | ACCUGAAGCACAGCAAAGC | 2082 | GCUUUGCUGUGCUUCAGGU | Rat,GP | | [284-302] ORF |
| 200 | 1826 | AAAAGGCUCCUGAGUGUGC | 2083 | GCACACUCAGGAGCCUUUU | | | [1092-1110] 3'UTR |
| 201 | 1827 | UAAGCAAGUGACUUCUGGG | 2084 | CCCAGAAGUCACUUGCUUA | | | [842-860] 3'UTR |
| 202 | 1828 | AAUCAGGGCCCAUCUUCUG | 2085 | CAGAAGAUGGGCCCUGAUU | | | [783-801] 3'UTR |
| 203 | 1829 | ACUCAGAAAUUGAACUCUC | 2086 | GAGAGUUCAAUUUCUGAGU | | | [1222-1240] 3'UTR |
| 204 | 1830 | GAACUCGAGCUGUAUCCUC | 2087 | GAGGAUACAGCUCGAGUUC | | | [1019-1037] 3'UTR |
| 205 | 1831 | AUGAAGCUGCUGUACCACU | 2088 | AGUGGUACAGCAGCUUCAU | | | [418-436] ORF |
| 206 | 1832 | UUGUACUCAGAAAUUGAAC | 2089 | GUUCAAUUUCUGAGUACAA | | | [1218-1236] 3'UTR |
| 207 | 1833 | UGGGCACGACUUUGUACUC | 2090 | GAGUACAAAGUCGUGCCCA | | | [1207-1225] 3'UTR |
| 208 | 1834 | UCUAUGAUAUUUGUAGUGC | 2091 | GCACUACAAAUAUCAUAGA | | | [882-900] 3'UTR |
| 209 | 1835 | UUGCAUUUAAGCAAGUGAC | 2092 | GUCACUUGCUUAAAUGCAA | | | [835-853] 3'UTR |
| 210 | 1836 | AAAGAGAAAAACCGACUGC | 2093 | GCAGUCGGUUUUUCUCUUU | | | [121-139] ORF |

FIGURE 4 Continued

| | | | | | | | |
|---|---|---|---|---|---|---|---|
| 211 | 1837 | UCGAGCUGUAUCCUCAUAG | 2094 | CUAUGAGGAUACAGCUCGA | | | [1023-1041] 3'UTR |
| 212 | 1838 | UAGAGGACUUUCUUCAGGG | 2095 | CCCUGAAGAAAGUCCUCUA | Ms | | [931-949] 3'UTR |
| 213 | 1839 | UGUCAGCUACCUGAAGCAC | 2096 | GUGCUUCAGGUAGCUGACA | | | [276-294] ORF |
| 214 | 1840 | AGAAAUUGAACUCUCAGUC | 2097 | GACUGAGAGUUCAAUUUCU | | | [1226-1244] 3'UTR |
| 215 | 1841 | UGAUCCUUAAAGGAUUCCU | 2098 | AGGAAUCCUUUAAGGAUCA | Ms | | [1169-1187] 3'UTR |
| 216 | 1842 | AUCCUGGAGAUGGCUGUCA | 2099 | UGACAGCCAUCUCCAGGAU | | | [262-280] ORF |
| 217 | 1843 | AUUCUCAGAGAAUGUGUGU | 2100 | ACACACAUUCUCUGAGAAU | | | [740-758] 3'UTR |
| 218 | 1844 | UCCUUAAAGGAUUCCUCUG | 2101 | CAGAGGAAUCCUUUAAGGA | | | [1172-1190] 3'UTR |
| 219 | 1845 | UAUGAUCCUUAAAGGAUUC | 2102 | GAAUCCUUUAAGGAUCAUA | | | [1167-1185] 3'UTR |
| 220 | 1846 | UGUAUCCUCAUAGGAAACA | 2103 | UGUUUCCUAUGAGGAUACA | | | [1029-1047] 3'UTR |
| 221 | 1847 | UCUCAGAGAAUGUGUGUGC | 2104 | GCACACACAUUCUCUGAGA | | | [742-760] 3'UTR |
| 222 | 1848 | UGAACUCUCAGUCACGUGG | 2105 | CCACGUGACUGAGAGUUCA | | | [1232-1250] 3'UTR |
| 223 | 1849 | GUACUCAGAAAUUGAACUC | 2106 | GAGUUCAAUUUCUGAGUAC | | | [1220-1238] 3'UTR |
| 224 | 1850 | AAAAUCUGAUUGUUCAGCC | 2107 | GGCUGAACAAUCAGAUUUU | | | [1283-1301] 3'UTR |
| 225 | 1851 | AAUGUGUGUGCAGAGUCCC | 2108 | GGGACUCUGCACACACAUU | | | [750-768] 3'UTR |
| 226 | 1852 | ACUACAGCGAAGGCUACUC | 2109 | GAGUAGCCUUCGCUGUAGU | | | [341-359] ORF |
| 227 | 1853 | AAGGAUUCCUCUGUGUGGG | 2110 | CCCACACAGAGGAAUCCUU | | | [1178-1196] 3'UTR |
| 228 | 1854 | UAAAGGAUUCCUCUGUGUG | 2111 | CACACAGAGGAAUCCUUUA | | | [1176-1194] 3'UTR |
| 229 | 1855 | UAGGAAACAGUGAUCACCC | 2112 | GGGUGAUCACUGUUUCCUA | | | [1039-1057] 3'UTR |
| 230 | 1856 | UUGCCUUUUGUGAAGGCC | 2113 | CGGCCUUCACAAAAGGCAA | | | [1001-1019] 3'UTR |
| 231 | 1857 | UCUGUGUUUGCAUUUAAGC | 2114 | GCUUAAAUGCAAACACAGA | | | [828-846] 3'UTR |
| 232 | 1858 | AAAAACCGACUGCGGAAGC | 2115 | GCUUCCGCAGUCGGUUUUU | Ms | | [127-145] ORF |
| 233 | 1859 | AACUCCAAGCUGGAGAAGG | 2116 | CCUUCUCCAGCUUGGAGUU | Ms,GP,Chn | | [238-256] ORF |
| 234 | 1860 | CAUUUGCCUUUUGUGAAGG | 2117 | CCUUCACAAAAGGCAAAUG | Ms | | [998-1016] 3'UTR |
| 235 | 1861 | ACUCUCAGUCACGUGGAAG | 2118 | CUUCCACGUGACUGAGAGU | | | [1235-1253] 3'UTR |
| 236 | 1862 | UACUCAGAAAUUGAACUCU | 2119 | AGAGUUCAAUUUCUGAGUA | | | [1221-1239] 3'UTR |
| 237 | 1863 | UUUAAGCAAGUGACUUCUG | 2120 | CAGAAGUCACUUGCUUAAA | | | [840-858] 3'UTR |
| 238 | 1864 | AGUGACUUCUGGGAAGUCC | 2121 | GGACUUCCCAGAAGUCACU | | | [848-866] 3'UTR |
| 239 | 1865 | AAGUGACUUCUGGGAAGUC | 2122 | GACUUCCCAGAAGUCACUU | GP,Chn | | [847-865] 3'UTR |
| 240 | 1866 | AAGCUGCUGUACCACUUCC | 2123 | GGAAGUGGUACAGCAGCUU | | | [421-439] ORF |
| 241 | 1867 | UUCCUCUGUGUGGUGGAU | 2124 | AUCCACCCACACAGAGGAA | | | [1183-1201] 3'UTR |
| 242 | 1868 | AUCCUCAUAGGAAACAGUG | 2125 | CACUGUUUCCUAUGAGGAU | | | [1032-1050] 3'UTR |
| 243 | 1869 | UUCUCAGAGAAUGUGUGUG | 2126 | CACACACAUUCUCUGAGAA | | | [741-759] 3'UTR |
| 244 | 1870 | AUAGGAAACAGUGAUCACC | 2127 | GGUGAUCACUGUUUCCUAU | | | [1038-1056] 3'UTR |
| 245 | 1871 | UUGAACUCUCAGUCACGUG | 2128 | CACGUGACUGAGAGUUCAA | | | [1231-1249] 3'UTR |
| 246 | 1872 | AUUUGCCUUUUGUGAAGGC | 2129 | GCCUUCACAAAAGGCAAAU | Ms | | [999-1017] 3'UTR |
| 247 | 1873 | CUUCUGCCAAGUGUCUGAC | 2130 | GUCAGACACUUGGCAGAAG | | | [796-814] 3'UTR |
| 248 | 1874 | AUCAACAGCAGCAUCGAGC | 2131 | GCUCGAUGCUGCUGUUGAU | Chn | | [175-193] ORF |
| 249 | 1875 | AUCUUCUGCCAAGUGUCUG | 2132 | CAGACACUUGGCAGAAGAU | | | [794-812] 3'UTR |
| 250 | 1876 | UUUUAGGACAAUCAGGGCC | 2133 | GGCCCUGAUUGUCCUAAAA | | | [774-792] 3'UTR |
| 251 | 1877 | AAGCACAGCAAAGCCUUCG | 2134 | CGAAGGCUUUGCUGUGCUU | Rat | | [289-307] ORF |
| 252 | 1878 | UUCUGCCAAGUGUCUGACC | 2135 | GGUCAGACACUUGGCAGAA | | | [797-815] 3'UTR |
| 253 | 1879 | UUUGUGAAGGCCGAACUCG | 2136 | CGAGUUCGGCCUUCACAAA | | | [1007-1025] 3'UTR |
| 254 | 1880 | UUUAGGACAAUCAGGGCCC | 2137 | GGGCCCUGAUUGUCCUAAA | | | [775-793] 3'UTR |
| 255 | 1881 | UAAAAUCUGAUUGUUCAGC | 2138 | GCUGAACAAUCAGAUUUUA | | | [1282-1300] 3'UTR |
| 256 | 1882 | UUUGCCUUUUGUGAAGGCC | 2139 | GGCCUUCACAAAAGGCAAA | | | [1000-1018] 3'UTR |
| 257 | 1883 | AUGAUCCUUAAAGGAUUCC | 2140 | GGAAUCCUUUAAGGAUCAU | Ms | | [1168-1186] 3'UTR |

Table A3 ID1 - inhibitor of DNA binding 1

| No. | SEQ ID NO. | Sense siRNA | SEQ ID NO. | AntiSense siRNA | Other Sp | Human-31317296 ORF:100-567 | Human-31317296 ORF:100-549 |
|---|---|---|---|---|---|---|---|
| 1 | 2141 | CAAUGAUCACCGACUGAAA | 2424 | UUUCAGUCGGUGAUCAUUG | | [901-919] 3'UTR | [1140-1158] 3'UTR |
| 2 | 2142 | CGGAUCUGAGGGAGAACAA | 2425 | UUGUUCUCCCUCAGAUCCG | | [656-674] 3'UTR | [895-913] 3'UTR |
| 3 | 2143 | AGGUAAACGUGCUGCUCUA | 2426 | UAGAGCAGCACGUUUACCU | Chp | [281-299] ORF | [281-299] ORF |
| 4 | 2144 | UGGACGAGCAGCAGGUAAA | 2427 | UUUACCUGCUGCUCGUCCA | Chp | [269-287] ORF | [269-287] ORF |
| 5 | 2145 | GCUGAACUCGGAAUCCGAA | 2428 | UUCGGAUUCCGAGUUCAGC | GP,Chp | [423-441] ORF | [423-441] ORF |
| 6 | 2146 | GUUGGAGCUGAACUCGGAA | 2429 | UUCCGAGUUCAGCUCCAAC | GP | [417-435] ORF | [417-435] ORF |
| 7 | 2147 | CGUUCUUAACUGUUCCAUU | 2430 | AAUGGAACAGUUAAGAACG | | [7-25] 5'UTR | [7-25] 5'UTR |
| 8 | 2148 | AGUUGGAGCUGAACUCGGA | 2431 | UCCGAGUUCAGCUCCAACU | GP | [416-434] ORF | [416-434] ORF |
| 9 | 2149 | AAUGAUCACCGACUGAAAA | 2432 | UUUUCAGUCGGUGAUCAUU | | [902-920] 3'UTR | [1141-1159] 3'UTR |
| 10 | 2150 | GAGGGAGAACAAGACCGAU | 2433 | AUCGGUCUUGUUCUCCCUC | | [663-681] 3'UTR | [902-920] 3'UTR |
| 11 | 2151 | GAUCUGAGGGAGAACAAGA | 2434 | UCUUGUUCUCCCUCAGAUC | | [658-676] 3'UTR | [897-915] 3'UTR |
| 12 | 2152 | CAGUCGCCAAGAAUCAUGA | 2435 | UCAUGAUUCUUGGCGACUG | | [85-103] 5'UTR+ORF | [85-103] 5'UTR+ORF |
| 13 | 2153 | AGUCGCCAAGAAUCAUGAA | 2436 | UUCAUGAUUCUUGGCGACU | | [86-104] 5'UTR+ORF | [86-104] 5'UTR+ORF |
| 14 | 2154 | GGAUCUGAGGGAGAACAAG | 2437 | CUUGUUCUCCCUCAGAUCC | | [657-675] 3'UTR | [896-914] 3'UTR |
| 15 | 2155 | ACUACAUCAGGGACCUUCA | 2438 | UGAAGGUCCCUGAUGUAGU | | [398-416] ORF | [398-416] ORF |
| 16 | 2156 | UGCUGCUCUACGACAUGAA | 2439 | UUCAUGUCGUAGAGCAGCA | GP,Chn,Chp | [290-308] ORF | [290-308] ORF |

FIGURE 4 Continued

| | | | | | | | |
|---|---|---|---|---|---|---|---|
| 17 | 2157 | UGAGGGAGAACAAGACCGA | 2440 | UCGGUCUUGUUCUCCCUCA | | [662-680] 3'UTR | [901-919] 3'UTR |
| 18 | 2158 | GCUUCCACCUCAUUUUUU | 2441 | AAAAAAAUGAGGUGGAAGC | | [43-61] 5'UTR | [43-61] 5'UTR |
| 19 | 2159 | CGCAUCUUGUGUCGCUGAA | 2442 | UUCAGCGACACAAGAUGCG | GP,Chn,Chp | [550-568] ORF+3'UTR | [789-807] 3'UTR |
| 20 | 2160 | AGCUGAACUCGGAAUCCGA | 2443 | UCGGAUUCCGAGUUCAGCU | GP,Chp | [422-440] ORF | [422-440] ORF |
| 21 | 2161 | GGGCUGUUUUUUUGUUAUU | 2444 | AAUAACAAAAAAACAGCCC | Chp | [944-962] 3'UTR | [1183-1201] 3'UTR |
| 22 | 2162 | AGGUGGAGAUUCUCCAGCA | 2445 | UGCUGGAGAAUCUCCACCU | Chp | [371-389] ORF | [371-389] ORF |
| 23 | 2163 | GCAAGGUGGAGAUUCUCCA | 2446 | UGGAGAAUCUCCACCUUGC | Chp | [368-386] ORF | [368-386] ORF |
| 24 | 2164 | AGGUGAGCAAGGUGGAGAU | 2447 | AUCUCCACCUUGCUCACCU | Chp | [362-380] ORF | [362-380] ORF |
| 25 | 2165 | GCCAGUCGCCAAGAAUCAU | 2448 | AUGAUUCUUGGCGACUGGC | | [83-101] 5'UTR+ORF | [83-101] 5'UTR+ORF |
| 26 | 2166 | ACGUUUGGUGCUUCUCAGA | 2449 | UCUGAGAAGCACCAAACGU | Chp | [850-868] 3'UTR | [1089-1107] 3'UTR |
| 27 | 2167 | CACGUUUGGUGCUUCUCAG | 2450 | CUGAGAAGCACCAAACGUG | Chp | [849-867] 3'UTR | [1088-1106] 3'UTR |
| 28 | 2168 | CUCGGAAUCCGAAGUUGGA | 2451 | UCCAACUUCGGAUUCCGAG | | [429-447] ORF | [429-447] ORF |
| 29 | 2169 | AUAUUACAAUGAUCACCGA | 2452 | UCGGUGAUCAUUGUAAUAU | Chp | [895-913] 3'UTR | [1134-1152] 3'UTR |
| 30 | 2170 | CCAUUUUCCGUAUCUGCUU | 2453 | AAGCAGAUACGGAAAAUGG | | [21-39] 5'UTR | [21-39] 5'UTR |
| 31 | 2171 | CUUUGCCCAUUCUGUUUCA | 2454 | UGAAACAGAAUGGGCAAAG | Chp | [64-82] 5'UTR | [64-82] 5'UTR |
| 32 | 2172 | CGUUUGGUGCUUCUCAGAU | 2455 | AUCUGAGAAGCACCAAACG | Chp | [851-869] 3'UTR | [1090-1108] 3'UTR |
| 33 | 2173 | GAGAUUCUCCAGCACGUCA | 2456 | UGACGUGCUGGAGAAUCUC | | [376-394] ORF | [376-394] ORF |
| 34 | 2174 | GUCGCCAAGAAUCAUGAAA | 2457 | UUUCAUGAUUCUUGGCGAC | Chp | [87-105] 5'UTR+ORF | [87-105] 5'UTR+ORF |
| 35 | 2175 | GAUCACCGACUGAAAAUAU | 2458 | AUAUUUUCAGUCGGUGAUC | | [905-923] 3'UTR | [1144-1162] 3'UTR |
| 36 | 2176 | CCUCUCUGCACACCUACUA | 2459 | UAGUAGGUGUGCAGAGAGG | Chp | [753-771] 3'UTR | [992-1010] 3'UTR |
| 37 | 2177 | CAAGAAUCAUGAAAGUCGC | 2460 | GCGACUUUCAUGAUUCUUG | Chp | [92-110] 5'UTR+ORF | [92-110] 5'UTR+ORF |
| 38 | 2178 | CGCUUUGCCCAUUCUGUUU | 2461 | AAACAGAAUGGGCAAAGCG | Chp | [62-80] 5'UTR | [62-80] 5'UTR |
| 39 | 2179 | UUCUCAGAUUUCUGAGGAA | 2462 | UUCCUCAGAAAUCUGAGAA | Chp | [861-879] 3'UTR | [1100-1118] 3'UTR |
| 40 | 2180 | ACCUUCAGUUGGAGCUGAA | 2463 | UUCAGCUCCAACUGAAGGU | | [410-428] ORF | [410-428] ORF |
| 41 | 2181 | GCUGUUACUCACGCCUCAA | 2464 | UUGAGGCGUGAGUAACAGC | | [311-329] ORF | [311-329] ORF |
| 42 | 2182 | UGAUCACCGACUGAAAAUA | 2465 | UAUUUUCAGUCGGUGAUCA | | [904-922] 3'UTR | [1143-1161] 3'UTR |
| 43 | 2183 | ACACCUACUAGUCACCAGA | 2466 | UCUGGUGACUAGUAGGUGU | | [762-780] 3'UTR | [1001-1019] 3'UTR |
| 44 | 2184 | GAAUCAUGAAAGUCGCCAG | 2467 | CUGGCGACUUUCAUGAUUC | Chp | [95-113] 5'UTR+ORF | [95-113] 5'UTR+ORF |
| 45 | 2185 | CGGGCUUCCACCUCAUUUU | 2468 | AAAAUGAGGUGGAAGCCCG | | [40-58] 5'UTR | [40-58] 5'UTR |
| 46 | 2186 | AGAACCGCAAGGUGAGCAA | 2469 | UUGCUCACCUUGCGGUUCU | Chp | [353-371] ORF | [353-371] ORF |
| 47 | 2187 | GGAAUUACGUGCUCUGUGG | 2470 | CCACAGAGCACGUAAUUCC | Chp | [616-634] 3'UTR | [855-873] 3'UTR |
| 48 | 2188 | GUUACUCACGCCUCAAGGA | 2471 | UCCUUGAGGCGUGAGUAAC | | [314-332] ORF | [314-332] ORF |
| 49 | 2189 | GUUCUUAACUGUUCCAUUU | 2472 | AAAUGGAACAGUUAAGAAC | | [8-26] 5'UTR | [8-26] 5'UTR |
| 50 | 2190 | AGAUUCUCCAGCACGUCAU | 2473 | AUGACGUGCUGGAGAAUCU | | [377-395] ORF | [377-395] ORF |
| 51 | 2191 | ACGACAUGAACGGCUGUUA | 2474 | UAACAGCCGUUCAUGUCGU | Chp | [299-317] ORF | [299-317] ORF |
| 52 | 2192 | CCGACUGAAAAUAUUGUUU | 2475 | AAACAAUAUUUUCAGUCGG | | [910-928] 3'UTR | [1149-1167] 3'UTR |
| 53 | 2193 | CACCGACUGAAAAUAUUGU | 2476 | ACAAUAUUUUCAGUCGGUG | | [908-926] 3'UTR | [1147-1165] 3'UTR |
| 54 | 2194 | ACAAUGAUCACCGACUGAA | 2477 | UUCAGUCGGUGAUCAUUGU | | [900-918] 3'UTR | [1139-1157] 3'UTR |
| 55 | 2195 | CUCAGAUUUCUGAGGAAAU | 2478 | AUUUCCUCAGAAAUCUGAG | Chp | [863-881] 3'UTR | [1102-1120] 3'UTR |
| 56 | 2196 | AACUGUUCCAUUUUCCGUA | 2479 | UACGGAAAAUGGAACAGUU | | [14-32] 5'UTR | [14-32] 5'UTR |
| 57 | 2197 | UCGCUUUGCCCAUUCUGUU | 2480 | AACAGAAUGGGCAAAGCGA | Chp | [61-79] 5'UTR | [61-79] 5'UTR |
| 58 | 2198 | GGGCAAGAGGAAUUACGUG | 2481 | CACGUAAUUCCUCUUGCCC | Chp | [608-626] 3'UTR | [847-865] 3'UTR |
| 59 | 2199 | GCAUCUUGUGUCGCUGAAG | 2482 | CUUCAGCGACACAAGAUGC | GP,Chn,Chp | [551-569] ORF+3'UTR | [790-808] 3'UTR |
| 60 | 2200 | CGACUACAUCAGGGACCUU | 2483 | AAGGUCCCUGAUGUAGUCG | | [396-414] ORF | [396-414] ORF |
| 61 | 2201 | UCAUCGACUACAUCAGGGA | 2484 | UCCCUGAUGUAGUCGAUGA | Chn,Chp | [392-410] ORF | [392-410] ORF |
| 62 | 2202 | GGUGAGCAAGGUGGAGAUU | 2485 | AAUCUCCACCUUGCUCACC | Chp | [363-381] ORF | [363-381] ORF |
| 63 | 2203 | CUACGACAUGAACGGCUGU | 2486 | ACAGCCGUUCAUGUCGUAG | Chp | [297-315] ORF | [297-315] ORF |
| 64 | 2204 | CUCGUGUGUUUCUAUUUUU | 2487 | AAAAAUAGAAACACACGAG | Chp | [803-821] 3'UTR | [1042-1060] 3'UTR |
| 65 | 2205 | UAAACGUGCUGCUCUACGA | 2488 | UCGUAGAGCAGCACGUUUA | Chp | [284-302] ORF | [284-302] ORF |
| 66 | 2206 | CCACCUCAUUUUUUCGCU | 2489 | AGCGAAAAAAAUGAGGUGG | | [47-65] 5'UTR | [47-65] 5'UTR |
| 67 | 2207 | GAGGAAUUACGUGCUCUGU | 2490 | ACAGAGCACGUAAUUCCUC | Chp | [614-632] 3'UTR | [853-871] 3'UTR |
| 68 | 2208 | UCGGAAUCCGAAGUUGGAA | 2491 | UUCCAACUUCGGAUUCCGA | | [430-448] ORF | [430-448] ORF |
| 69 | 2209 | CUACAUCAGGGACCUUCAG | 2492 | CUGAAGGUCCCUGAUGUAG | | [399-417] ORF | [399-417] ORF |
| 70 | 2210 | UGUUUCAGCCAGUCGCCAA | 2493 | UUGGCGACUGGCUGAAACA | | [76-94] 5'UTR | [76-94] 5'UTR |
| 71 | 2211 | CACGUUCUUAACUGUUCCA | 2494 | UGGAACAGUUAAGAACGUG | | [5-23] 5'UTR | [5-23] 5'UTR |
| 72 | 2212 | GGGCUUCCACCUCAUUUUU | 2495 | AAAAAUGAGGUGGAAGCCC | | [41-59] 5'UTR | [41-59] 5'UTR |
| 73 | 2213 | ACUGUUCCAUUUUCCGUAU | 2496 | AUACGGAAAAUGGAACAGU | | [15-33] 5'UTR | [15-33] 5'UTR |
| 74 | 2214 | UGGAGAUUCUCCAGCACGU | 2497 | ACGUGCUGGAGAAUCUCCA | Chp | [374-392] ORF | [374-392] ORF |
| 75 | 2215 | AGCCAGUCGCCAAGAAUCA | 2498 | UGAUUCUUGGCGACUGGCU | | [82-100] 5'UTR | [82-100] 5'UTR |
| 76 | 2216 | CUAGUCACCAGAGACUUUA | 2499 | UAAAGUCUCGGUGACUAG | Chp | [769-787] 3'UTR | [1008-1026] 3'UTR |
| 77 | 2217 | UACAAUGAUCACCGACUGA | 2500 | UCAGUCGGUGAUCAUUGUA | | [899-917] 3'UTR | [1138-1156] 3'UTR |
| 78 | 2218 | ACUCGUGUGUUUCUAUUUU | 2501 | AAAAAUAGAAACACACGAGU | | [802-820] 3'UTR | [1041-1059] 3'UTR |
| 79 | 2219 | ACGUGCUGCUCUACGACAU | 2502 | AUGUCGUAGAGCAGCACGU | GP,Chn,Chp | [287-305] ORF | [287-305] ORF |
| 80 | 2220 | CCAUUCUGUUUCAGCCAGU | 2503 | ACUGGCUGAAACAGAAUGG | | [70-88] 5'UTR | [70-88] 5'UTR |
| 81 | 2221 | CCACGUUCUUAACUGUUCC | 2504 | GGAACAGUUAAGAACGUGG | | [4-22] 5'UTR | [4-22] 5'UTR |
| 82 | 2222 | AUCACCGACUGAAAAUAUU | 2505 | AAUAUUUUCAGUCGGUGAU | | [906-924] 3'UTR | [1145-1163] 3'UTR |
| 83 | 2223 | ACCUACUAGUCACCAGAGA | 2506 | UCUCUGGUGACUAGUAGGU | Chp | [764-782] 3'UTR | [1003-1021] 3'UTR |
| 84 | 2224 | CUCUCUGCACACCUACUAG | 2507 | CUAGUAGGUGUGCAGAGAG | Chp | [754-772] 3'UTR | [993-1011] 3'UTR |

FIGURE 4 Continued

| | | | | | | | |
|---|---|---|---|---|---|---|---|
| 85 | 2225 | CGGAAUCCGAAGUUGGAAC | 2508 | GUUCCAACUUCGGAUUCCG | | [431-449] ORF | [431-449] ORF |
| 86 | 2226 | GAUUCUCCAGCACGUCAUC | 2509 | GAUGACGUGCUGGAGAAUC | Chp | [378-396] ORF | [378-396] ORF |
| 87 | 2227 | CAAGGUGGAGAUUCUCCAG | 2510 | CUGGAGAAUCUCCACCUUG | Chp | [369-387] ORF | [369-387] ORF |
| 88 | 2228 | GCUGCUCUACGACAUGAAC | 2511 | GUUCAUGUCGUAGAGCAGC | GP,Chn,Chp | [291-309] ORF | [291-309] ORF |
| 89 | 2229 | UCAGCCAGUCGCCAAGAAU | 2512 | AUUCUUGGCGACUGGCUGA | | [80-98] 5'UTR | [80-98] 5'UTR |
| 90 | 2230 | GUGCUUCUCAGAUUUCUGA | 2513 | UCAGAAAUCUGAGAAGCAC | Rat,Chp | [857-875] 3'UTR | [1096-1114] 3'UTR |
| 91 | 2231 | ACUAGUCACCAGAGACUUU | 2514 | AAAGUCUCUGGUGACUAGU | Chp | [788-786] 3'UTR | [1007-1025] 3'UTR |
| 92 | 2232 | GCCCAUUCUGUUUCAGCCA | 2515 | UGGCUGAAACAGAAUGGGC | | [68-86] 5'UTR | [68-86] 5'UTR |
| 93 | 2233 | ACCUCAUUUUUUCGCUUU | 2516 | AAAGCGAAAAAAAUGAGGU | | [49-67] 5'UTR | [49-67] 5'UTR |
| 94 | 2234 | UGGUGCUUCUCAGAUUUCU | 2517 | AGAAAUCUGAGAAGCACCA | Chp | [855-873] 3'UTR | [1094-1112] 3'UTR |
| 95 | 2235 | UCAUGAAAGUCGCCAGUGG | 2518 | CCACUGGCGACUUUCAUGA | Chp | [98-116] 5'UTR+ORF | [98-116] 5'UTR+ORF |
| 96 | 2236 | AUGAUCACCGACUGAAAAU | 2519 | AUUUUCAGUCGGUGAUCAU | | [903-921] 3'UTR | [1142-1160] 3'UTR |
| 97 | 2237 | UCUCAGAUUUCUGAGGAAA | 2520 | UUUCCUCAGAAAUCUGAGA | Chp | [862-880] 3'UTR | [1101-1119] 3'UTR |
| 98 | 2238 | UCACGUUUGGUGCUUCUCA | 2521 | UGAGAAGCACCAAACGUGA | Chp | [848-866] 3'UTR | [1087-1105] 3'UTR |
| 99 | 2239 | AAAAAAUGGUCACGUUUGG | 2522 | CCAAACGUGACCAUUUUUU | | [839-857] 3'UTR | [1078-1096] 3'UTR |
| 100 | 2240 | CGUGUGUUUCUAUUUUUUG | 2523 | CAAAAAAUAGAAACACACG | Chp | [805-823] 3'UTR | [1044-1062] 3'UTR |
| 101 | 2241 | UCGCAUCUUGUGUCGCUGA | 2524 | UCAGCGACACAAGAUGCGA | Ms,GP,Chn,Chp | [549-567] ORF | [788-806] 3'UTR |
| 102 | 2242 | CAUCGACUACAUCAGGGAC | 2525 | GUCCCUGAUGUAGUCGAUG | Chn,Chp | [393-411] ORF | [393-411] ORF |
| 103 | 2243 | GAGCAAGGUGGAGAUUCUC | 2526 | GAGAAUCUCCACCUUGCUC | Chp | [366-384] ORF | [366-384] ORF |
| 104 | 2244 | UCGCCAAGAAUCAUGAAAG | 2527 | CUUUCAUGAUUCUUGGCGA | Chp | [88-106] 5'UTR+ORF | [88-106] 5'UTR+ORF |
| 105 | 2245 | CCUCAUUUUUUCGCUUUG | 2528 | CAAAGCGAAAAAAAUGAGG | | [50-68] 5'UTR | [50-68] 5'UTR |
| 106 | 2246 | UCCACUCGUGUGUUUCUAU | 2529 | AUAGAAACACACGAGUGGA | | [799-817] 3'UTR | [1038-1056] 3'UTR |
| 107 | 2247 | GGGAUUCCACUCGUGUGUU | 2530 | AACACACGAGUGGAAUCCC | | [794-812] 3'UTR | [1033-1051] 3'UTR |
| 108 | 2248 | CACACCUACUAGUCACCAG | 2531 | CUGGUGACUAGUAGGUGUG | Chp | [761-779] 3'UTR | [1000-1018] 3'UTR |
| 109 | 2249 | AGCACGUCAUCGACUACAU | 2532 | AUGUAGUCGAUGACGUGCU | GP,Chn,Chp | [386-404] ORF | [386-404] ORF |
| 110 | 2250 | CCAAGAAUCAUGAAAGUCG | 2533 | CGACUUUCAUGAUUCUUGG | Chp | [91-109] 5'UTR+ORF | [91-109] 5'UTR+ORF |
| 111 | 2251 | UUUUUUCGCUUUGCCCAU | 2534 | AUGGGCAAAGCGAAAAAAA | | [55-73] 5'UTR | [55-73] 5'UTR |
| 112 | 2252 | GUUUUACAAUAGUUCUGUG | 2535 | CACAGAACUAUUGUAAAAC | Chp | [925-943] 3'UTR | [1164-1182] 3'UTR |
| 113 | 2253 | GAUUUCUGAGGAAAUUGCU | 2536 | AGCAAUUUCCUCAGAAAUC | Chp | [867-885] 3'UTR | [1106-1124] 3'UTR |
| 114 | 2254 | GGUGCUUCUCAGAUUUCUG | 2537 | CAGAAAUCUGAGAAGCACC | Chp | [856-874] 3'UTR | [1095-1113] 3'UTR |
| 115 | 2255 | AUUCCACGUUCUUAACUGU | 2538 | ACAGUUAAGAACGUGGAAU | | [1-19] 5'UTR | [1-19] 5'UTR |
| 116 | 2256 | AAUCAUGAAAGUCGCCAGU | 2539 | ACUGGCGACUUUCAUGAUU | Chp | [96-114] 5'UTR+ORF | [96-114] 5'UTR+ORF |
| 117 | 2257 | CCAGUCGCCAAGAAUCAUG | 2540 | CAUGAUUCUUGGCGACUGG | | [84-102] 5'UTR+ORF | [84-102] 5'UTR+ORF |
| 118 | 2258 | AUUUUUUCGCUUUGCCCA | 2541 | UGGGCAAAGCGAAAAAAAU | | [54-72] 5'UTR | [54-72] 5'UTR |
| 119 | 2259 | CUUCUCAGAUUUCUGAGGA | 2542 | UCCUCAGAAAUCUGAGAAG | Chp | [860-878] 3'UTR | [1099-1117] 3'UTR |
| 120 | 2260 | UCCUCUCUGCACACCUACU | 2543 | AGUAGGUGUGCAGAGAGGA | Chp | [752-770] 3'UTR | [991-1009] 3'UTR |
| 121 | 2261 | CAAGGAGAAUUACGUGCUC | 2544 | GAGCACGUAAUUCCUCUUG | Chp | [611-629] 3'UTR | [850-868] 3'UTR |
| 122 | 2262 | GACCUUCAGUUGGAGCUGA | 2545 | UCAGCUCCAACUGAAGGUC | | [409-427] ORF | [409-427] ORF |
| 123 | 2263 | ACAUCAGGGACCUUCAGUU | 2546 | AACUGAAGGUCCCUGAUGU | | [401-419] ORF | [401-419] ORF |
| 124 | 2264 | CACGUCAUCGACUACAUCA | 2547 | UGAUGUAGUCGAUGACGUG | GP,Chn,Chp | [388-406] ORF | [388-406] ORF |
| 125 | 2265 | UCAGAUUUCUGAGGAAAUU | 2548 | AAUUUCCUCAGAAAUCUGA | Chp | [864-882] 3'UTR | [1103-1121] 3'UTR |
| 126 | 2266 | ACUGCGCCCUUAACUGCAU | 2549 | AUGCAGUUAAGGGCGCAGU | Chp | [690-708] 3'UTR | [929-947] 3'UTR |
| 127 | 2267 | UUCAGCCAGUCGCCAAGAA | 2550 | UUCUUGGCGACUGGCUGAA | | [79-97] 5'UTR | [79-97] 5'UTR |
| 128 | 2268 | CAAGAGGAAUUACGUGCU | 2551 | AGCACGUAAUUCCUCUUG | Chp | [610-628] 3'UTR | [849-867] 3'UTR |
| 129 | 2269 | CACCUCAUUUUUUCGCUU | 2552 | AAGCGAAAAAAAUGAGGUG | | [48-66] 5'UTR | [48-66] 5'UTR |
| 130 | 2270 | ACCGACUGAAAAUAUUGUU | 2553 | AACAAUAUUUUCAGUCGGU | | [909-927] 3'UTR | [1148-1166] 3'UTR |
| 131 | 2271 | AUCUGAGGGAGAACAAGAC | 2554 | GUCUUGUUCUCCCUCAGAU | | [659-677] 3'UTR | [898-916] 3'UTR |
| 132 | 2272 | CCUUCAGUUGGAGCUGAAC | 2555 | GUUCAGCUCCAACUGAAGG | | [411-429] ORF | [411-429] ORF |
| 133 | 2273 | UCGACUACAUCAGGGACCU | 2556 | AGGUCCCUGAUGUAGUCGA | Rat,Ms,Chn,Chp | [395-413] ORF | [395-413] ORF |
| 134 | 2274 | GGUAAACGUGCUGCUCUAC | 2557 | GUAGAGCAGCACGUUUACC | Chp | [282-300] ORF | [282-300] ORF |
| 135 | 2275 | AGGAAUUACGUGCUCUGUG | 2558 | CACAGAGCACGUAAUUCCU | Chp | [615-633] 3'UTR | [854-872] 3'UTR |
| 136 | 2276 | UUCUCCAGCACGUCAUCGA | 2559 | UCGAUGACGUGCUGGAGAA | Chp | [380-398] ORF | [380-398] ORF |
| 137 | 2277 | AUGAAAGUCGCCAGUGGCA | 2560 | UGCCACUGGCGACUUUCAU | Chp | [100-118] ORF | [100-118] ORF |
| 138 | 2278 | UUCGCUUUGCCCAUUCUGU | 2561 | ACAGAAUGGGCAAAGCGAA | Chp | [60-78] 5'UTR | [60-78] 5'UTR |
| 139 | 2279 | GGCUUCCACCUCAUUUUU | 2562 | AAAAAAUGAGGUGGAAGCC | | [42-60] 5'UTR | [42-60] 5'UTR |
| 140 | 2280 | CACUCGUGUGUUUCUAUUU | 2563 | AAAUAGAAACACACGAGUG | | [801-819] 3'UTR | [1040-1058] 3'UTR |
| 141 | 2281 | CGUCAUCGACUACAUCAGG | 2564 | CCUGAUGUAGUCGAUGACG | Chn,Chp | [390-408] ORF | [390-408] ORF |
| 142 | 2282 | CAGGUAAACGUGCUGCUCU | 2565 | AGAGCAGCACGUUUACCUG | Chp | [280-298] ORF | [280-298] ORF |
| 143 | 2283 | CCUACUAGUCACCAGAGAC | 2566 | GUCUCUGGUGACUAGUAGG | Chp | [765-783] 3'UTR | [1004-1022] 3'UTR |
| 144 | 2284 | UCUGCACACCUACUAGUCA | 2567 | UGACUAGUAGGUGUGCAGA | Chp | [757-775] 3'UTR | [996-1014] 3'UTR |
| 145 | 2285 | GAAUUACGUGCUCUGUGGG | 2568 | CCCACAGAGCACGUAAUUC | Chp | [617-635] 3'UTR | [856-874] 3'UTR |
| 146 | 2286 | ACGAGCAGCAGGUAAACGU | 2569 | ACGUUUACCUGCUGCUCGU | Chp | [272-290] ORF | [272-290] ORF |
| 147 | 2287 | UCACCGACUGAAAAUAUUG | 2570 | CAAUAUUUUCAGUCGGUGA | | [907-925] 3'UTR | [1146-1164] 3'UTR |
| 148 | 2288 | GAUCGCAUCUUGUGUCGCU | 2571 | AGCGACACAAGAUGCGAUC | Ms,GP,Chn,Chp | [547-565] ORF | [786-804] 3'UTR |
| 149 | 2289 | UCCAUUUUCCGUAUCUGCU | 2572 | AGCAGAUACGGAAAAUGGA | | [20-38] 5'UTR | [20-38] 5'UTR |
| 150 | 2290 | GUUCCAUUUUCCGUAUCUG | 2573 | CAGAUACGGAAAAUGGAAC | | [18-38] 5'UTR | [18-38] 5'UTR |
| 151 | 2291 | UGUUCCAUUUUCCGUAUCU | 2574 | AGAUACGGAAAAUGGAACA | | [17-35] 5'UTR | [17-35] 5'UTR |
| 152 | 2292 | UCUACGACAUGAACGGCUG | 2575 | CAGCCGUUCAUGUCGUAGA | Rat,Ms,Chn,Chp | [296-314] ORF | [296-314] ORF |

FIGURE 4 Continued

| | | | | | | | |
|---|---|---|---|---|---|---|---|
| 153 | 2293 | AAAAAUGGUCACGUUUGGU | 2576 | ACCAAACGUGACCAUUUUU | Chp | [840-858] 3'UTR | [1079-1097] 3'UTR |
| 154 | 2294 | UUACGUGCUCUGUGGGUCU | 2577 | AGACCCACAGAGCACGUAA | Chp | [620-638] 3'UTR | [859-877] 3'UTR |
| 155 | 2295 | CAUUUUUUCGCUUUGCCC | 2578 | GGGCAAAGCGAAAAAAAUG | | [53-71] 5'UTR | [53-71] 5'UTR |
| 156 | 2296 | UUACAAUGAUCACCGACUG | 2579 | CAGUCGGUGAUCAUUGUAA | | [898-916] 3'UTR | [1137-1155] 3'UTR |
| 157 | 2297 | CUACUAGUCACCAGAGACU | 2580 | AGUCUCUGGUGACUAGUAG | Chp | [766-784] 3'UTR | [1005-1023] 3'UTR |
| 158 | 2298 | UGAACUCGGAAUCCGAAGU | 2581 | ACUUCGGAUUCCGAGUUCA | GP,Chp | [425-443] ORF | [425-443] ORF |
| 159 | 2299 | AUGAACGGCUGUUACUCAC | 2582 | GUGAGUAACAGCCGUUCAU | Chp | [304-322] ORF | [304-322] ORF |
| 160 | 2300 | AGAAUCAUGAAAGUCGCCA | 2583 | UGGCGACUUUCAUGAUUCU | Chp | [94-112] 5'UTR+ORF | [94-112] 5'UTR+ORF |
| 161 | 2301 | CAUUCUGUUUCAGCCAGUC | 2584 | GACUGGCUGAAACAGAAUG | | [71-89] 5'UTR | [71-89] 5'UTR |
| 162 | 2302 | GCACACCUACUAGUCACCA | 2585 | UGGUGACUAGUAGGUGUGC | Chp | [760-778] 3'UTR | [999-1017] 3'UTR |
| 163 | 2303 | CAUUUUCCGUAUCUGCUUC | 2586 | GAAGCAGAAUACGGAAAAUG | | [22-40] 5'UTR | [22-40] 5'UTR |
| 164 | 2304 | CUGAACUCGGAAUCCGAAG | 2587 | CUUCGGAUUCCGAGUUCAG | GP,Chp | [424-442] ORF | [424-442] ORF |
| 165 | 2305 | UUCCACUCGUGUGUUUCUA | 2588 | UAGAAACACACGAGUGGAA | | [798-816] 3'UTR | [1037-1055] 3'UTR |
| 166 | 2306 | UAGUCACCAGAGACUUUAG | 2589 | CUAAAGUCUCUGGUGACUA | Chp | [770-788] 3'UTR | [1009-1027] 3'UTR |
| 167 | 2307 | AGAGGAAUUACGUGCUCUG | 2590 | CAGAGCACGUAAUUCCUCU | Chp | [613-631] 3'UTR | [852-870] 3'UTR |
| 168 | 2308 | ACGUCAUCGACUACAUCAG | 2591 | CUGAUGUAGUCGAUGACGU | GP,Chn,Chp | [389-407] ORF | [389-407] ORF |
| 169 | 2309 | AACGUGCUGCUCUACGACA | 2592 | UGUCGUAGAGCAGCACGUU | GP,Chn,Chp | [286-304] ORF | [286-304] ORF |
| 170 | 2310 | CUUCCACCUCAUUUUUUCC | 2593 | GAAAAAAAUGAGGUGGAAG | | [44-62] 5'UTR | [44-62] 5'UTR |
| 171 | 2311 | UUCGGGCUUCCACCUCAUU | 2594 | AAUGAGGUGGAAGCCCGAA | | [38-56] 5'UTR | [38-56] 5'UTR |
| 172 | 2312 | CCUUAACUGCACCAGCCU | 2595 | AGGCUGGAUGCAGUUAAGG | | [697-715] 3'UTR | [936-954] 3'UTR |
| 173 | 2313 | UUGGAGCUGAACUCGGAAU | 2596 | AUUCCGAGUUCAGCUCCAA | GP | [418-436] ORF | [418-436] ORF |
| 174 | 2314 | AAGGUGAGCAAGGUGGAGA | 2597 | UCUCCACCUUGCUCACCUU | Chp | [361-379] ORF | [361-379] ORF |
| 175 | 2315 | CUGUUACUCACGCCUCAAG | 2598 | CUUGAGGCGUGAGUAACAG | | [312-330] ORF | [312-330] ORF |
| 176 | 2316 | UAACGUUCCAUUUUCCGU | 2599 | ACGGAAAAUGGAACAGUUA | | [13-31] 5'UTR | [13-31] 5'UTR |
| 177 | 2317 | CUCUACGACAUGAACGGCU | 2600 | AGCCGUUCAUGUCGUAGAG | Rat,Ms,Chn,Chp | [295-313] ORF | [295-313] ORF |
| 178 | 2318 | ACGUUCUUAACUGUUCCAU | 2601 | AUGGAACAGUUAAGAACGU | | [6-24] 5'UTR | [6-24] 5'UTR |
| 179 | 2319 | AUUUCUGGAGGAAAUUGCUU | 2602 | AAGCAAUUUCCUCAGAAAU | U | [868-886] 3'UTR | [1107-1125] 3'UTR |
| 180 | 2320 | AAUGGUCACGUUUGGUGCU | 2603 | AGCACCAAACGUGACCAUU | Chp | [843-861] 3'UTR | [1082-1100] 3'UTR |
| 181 | 2321 | CACCUACUAGUCACCAGAG | 2604 | CUCUGGUGACUAGUAGGUG | Chp | [763-781] 3'UTR | [1002-1020] 3'UTR |
| 182 | 2322 | CUGCACACCUACUAGUCAC | 2605 | GUGACUAGUAGGUGUGCAG | Chp | [758-776] 3'UTR | [997-1015] 3'UTR |
| 183 | 2323 | AAUUACGUGCUCUGUGGGU | 2606 | ACCCACAGAGCACGUAAUU | Chp | [618-636] 3'UTR | [857-875] 3'UTR |
| 184 | 2324 | UCUUAACUGUUCCAUUUUC | 2607 | GAAAAUGGAACAGUUAAGA | | [10-28] 5'UTR | [10-28] 5'UTR |
| 185 | 2325 | AUUACAAUGAUCACCGACU | 2608 | AGUCGGUGAUCAUUGUAAU | | [897-915] 3'UTR | [1136-1154] 3'UTR |
| 186 | 2326 | UCGGGCUUCCACCUCAUUU | 2609 | AAAUGAGGUGGAAGCCCGA | | [39-57] 5'UTR | [39-57] 5'UTR |
| 187 | 2327 | UAAAAAAUGGUCACGUUUG | 2610 | CAAACGUGACCAUUUUUUA | Chn | [838-856] 3'UTR | [1077-1095] 3'UTR |
| 188 | 2328 | UGGGAUUCCACUCGUGUGU | 2611 | ACACACGAGUGGAAUCCCA | | [793-811] 3'UTR | [1032-1050] 3'UTR |
| 189 | 2329 | CUUCAGUUGGAGCUGAACU | 2612 | AGUUCAGCUCCAACUGAAG | | [412-430] ORF | [412-430] ORF |
| 190 | 2330 | AGAAUUCUGAGGAAAUUGC | 2613 | GCAAUUUCCUCAGAAAUCU | Chp | [866-884] 3'UTR | [1105-1123] 3'UTR |
| 191 | 2331 | UUAACUGCAUCCAGCCUGG | 2614 | CCAGGCUGGAUGCAGUUAA | | [699-717] 3'UTR | [938-956] 3'UTR |
| 192 | 2332 | ACAUGAACGGCUGUUACUC | 2615 | GAGUAACAGCCGUUCAUGU | Chp | [302-320] ORF | [302-320] ORF |
| 193 | 2333 | CUUAACUGUUCCAUUUUCC | 2616 | GGAAAAUGGAACAGUUAAG | | [11-29] 5'UTR | [11-29] 5'UTR |
| 194 | 2334 | UUUCAGCCAGUCGCCAAGA | 2617 | UCUUGGCGACUGGCUGAAA | | [78-96] 5'UTR | [78-96] 5'UTR |
| 195 | 2335 | CCCAUUCUGUUUCAGCCAG | 2618 | CUGGCUGAAACAGAAUGGG | | [69-87] 5'UTR | [69-87] 5'UTR |
| 196 | 2336 | AUUCCACUCGUGUGUUUCU | 2619 | AGAAACACACGAGUGGAAU | | [797-815] 3'UTR | [1036-1054] 3'UTR |
| 197 | 2337 | CAUCUUGUGUCGCUGAAGC | 2620 | GCUUCAGCGACACAAGAUG | Chp | [552-570] ORF+3'UTR | [791-809] 3'UTR |
| 198 | 2338 | GAACUCGGAAUCCGAAGUU | 2621 | AACUUCGGAUUCCGAGUUC | Chp | [426-444] ORF | [426-444] ORF |
| 199 | 2339 | AAACGUGCUGCUCUACGAC | 2622 | GUCGUAGAGCAGCACGUUU | Chp | [285-303] ORF | [285-303] ORF |
| 200 | 2340 | UCAUUUUUUCGCUUUGCC | 2623 | GGCAAAGCGAAAAAAAUGA | | [52-70] 5'UTR | [52-70] 5'UTR |
| 201 | 2341 | UUUCUGAGGAAAUUGCUUU | 2624 | AAAGCAAUUUCCUCAGAAA | Chp | [869-887] 3'UTR | [1108-1126] 3'UTR |
| 202 | 2342 | CAGCACGUCAUCGACUACA | 2625 | UGUAGUCGAUGACGUGCUG | GP,Chn,Chp | [385-403] ORF | [385-403] ORF |
| 203 | 2343 | UUUUUUCGCUUUGCCAUU | 2626 | AAUGGGCAAAGCGAAAAA | | [56-74] 5'UTR | [56-74] 5'UTR |
| 204 | 2344 | UUCUGAGGAAAUUGCUUUG | 2627 | CAAAGCAAUUUCCUCAGAA | | [870-888] 3'UTR | [1109-1127] 3'UTR |
| 205 | 2345 | UCUCUGCACACCUACUAGU | 2628 | ACUAGUAGGUGUGCAGAGA | Chp | [755-773] 3'UTR | [994-1012] 3'UTR |
| 206 | 2346 | ACUCGGAAUCCGAAGUUGG | 2629 | CCAACUUCGGAUUCCGAGU | Chp | [428-446] ORF | [428-446] ORF |
| 207 | 2347 | GUCAUCGACUACAUCAGGG | 2630 | CCCUGAUGUAGUCGAUGAC | Chn,Chp | [391-409] ORF | [391-409] ORF |
| 208 | 2348 | AGCAGGUAAACGUGCUGCU | 2631 | AGCAGCACGUUUACCUGCU | Chp | [278-296] ORF | [278-296] ORF |
| 209 | 2349 | AGCAGCAGGUAAACGUGCU | 2632 | AGCACGUUUACCUGCUGCU | | [275-293] ORF | [275-293] ORF |
| 210 | 2350 | CUCUGCACACCUACUAGUC | 2633 | GACUAGUAGGUGUGCAGAG | Chp | [756-774] 3'UTR | [995-1013] 3'UTR |
| 211 | 2351 | UCUGAGGGAGAACAAGACC | 2634 | GGUCUUGUUCUCCCUCAGA | | [660-678] 3'UTR | [899-917] 3'UTR |
| 212 | 2352 | UCCACGUUCUUAACUGUUC | 2635 | GAACAGUUAAGAACGUGGA | | [3-21] 5'UTR | [3-21] 5'UTR |
| 213 | 2353 | UUUUCGCUUUGCCCAUUCU | 2636 | AGAAUGGGCAAAGCGAAAA | | [58-76] 5'UTR | [58-76] 5'UTR |
| 214 | 2354 | CAGAUUUCUGAGGAAAUUG | 2637 | CAAUUUCCUCAGAAAUCUG | Chp | [865-883] 3'UTR | [1104-1122] 3'UTR |
| 215 | 2355 | UGGUCACGUUUGGUGCUUC | 2638 | GAAGCACCAAACGUGACCA | Chp | [845-863] 3'UTR | [1084-1102] 3'UTR |
| 216 | 2356 | UGUUACUCACGCCUCAAGG | 2639 | CCUUGAGGCGUGAGUAACA | | [313-331] ORF | [313-331] ORF |
| 217 | 2357 | GUAAACGUGCUGCUCUACG | 2640 | CGUAGAGCAGCACGUUUAC | Chp | [283-301] ORF | [283-301] ORF |
| 218 | 2358 | UACUAGUCACCAGAGACUU | 2641 | AAGUCUCUGGUGACUAGUA | Chp | [767-785] 3'UTR | [1006-1024] 3'UTR |
| 219 | 2359 | GACUACAUCAGGGACCUUC | 2642 | GAAGGUCCCUGAUGUAGUC | | [397-415] ORF | [397-415] ORF |
| 220 | 2360 | GCCAAGAAUCAUGAAAGUC | 2643 | GACUUUCAUGAUUCUUGGC | Chp | [90-108] 5'UTR+ORF | [90-108] 5'UTR+ORF |

FIGURE 4 Continued

| | | | | | | | |
|---|---|---|---|---|---|---|---|
| 221 | 2361 | UAUUACAAUGAUCACCGAC | 2644 | GUCGGUGAUCAUUGUAAUA | | [896-914] 3'UTR | [1135-1153] 3'UTR |
| 222 | 2362 | GCUUCUCAGAUUUCUGAGG | 2645 | CCUCAGAAAUCUGAGAAGC | Chp | [859-877] 3'UTR | [1098-1116] 3'UTR |
| 223 | 2363 | UGGAGCUGAACUCGGAAUC | 2646 | GAUUCCGAGUUCAGCUCCA | GP | [419-437] ORF | [419-437] ORF |
| 224 | 2364 | CUGUUCCAUUUUCCGUAUC | 2647 | GAUACGGAAAAUGGAACAG | | [16-34] 5'UTR | [16-34] 5'UTR |
| 225 | 2365 | UUAACUGUUCCAUUUUCCG | 2648 | CGGAAAAUGGAACAGUUAA | | [12-30] 5'UTR | [12-30] 5'UTR |
| 226 | 2366 | UUCCACGUUCUUAACUGUU | 2649 | AACAGUUAAGAACGUGGAA | | [2-20] 5'UTR | [2-20] 5'UTR |
| 227 | 2367 | GCUUUGCCCAUUCUGUUCC | 2650 | GAAACAGAAUGGGCAAAGC | Chp | [63-81] 5'UTR | [63-81] 5'UTR |
| 228 | 2368 | GUAUAUUACAAUGAUCACC | 2651 | GGUGAUCAUUGUAAUAUAC | Chp | [893-911] 3'UTR | [1132-1150] 3'UTR |
| 229 | 2369 | GAUUCCACUCGUGUGUUCC | 2652 | GAAACACACGAGUGGAAUC | | [796-814] 3'UTR | [1035-1053] 3'UTR |
| 230 | 2370 | AAGAGGAAUUACGUGCUCU | 2653 | AGAGCACGUAAUUCCUCUU | Chp | [612-630] 3'UTR | [851-869] 3'UTR |
| 231 | 2371 | GUGAGCAAGGUGGAGAUUC | 2654 | GAAUCUCCACCUUGCUCAC | Chp | [364-382] ORF | [364-382] ORF |
| 232 | 2372 | UGCUCUACGACAUGAACGG | 2655 | CCGUUCAUGUCGUAGAGCA | Rat,Ms,GP,Chn,Chp | [293-311] ORF | [293-311] ORF |
| 233 | 2373 | AAGAAUCAUGAAAGUCGCC | 2656 | GGCGACUUUCAUGAUUCUU | Chp | [93-111] 5'UTR+ORF | [93-111] 5'UTR+ORF |
| 234 | 2374 | UGCUUCUCAGAUUUCUGAG | 2657 | CUCAGAAAUCUGAGAAGCA | Rat,Chp | [858-876] 3'UTR | [1097-1115] 3'UTR |
| 235 | 2375 | UAUCUGCUUCGGGCUUCCA | 2658 | UGGAAGCCCGAAGCAGAUA | | [31-49] 5'UTR | [31-49] 5'UTR |
| 236 | 2376 | UGCCCAUUCUGUUUCAGCC | 2659 | GGCUGAAACAGAAUGGGCA | Chp | [67-85] 5'UTR | [67-85] 5'UTR |
| 237 | 2377 | UCUGAGGAAAUUGCUUUGU | 2660 | ACAAAGCAAUUUCCUCAGA | | [871-889] 3'UTR | [1110-1128] 3'UTR |
| 238 | 2378 | AAAUGGUCACGUUUGGUGC | 2661 | GCACCAAACGUGACCAUUU | Chp | [842-860] 3'UTR | [1081-1099] 3'UTR |
| 239 | 2379 | GGCAAGAGGAAUUACGUGC | 2662 | GCACGUAAUUCCUCUUGCC | Chp | [609-627] 3'UTR | [848-866] 3'UTR |
| 240 | 2380 | UUCCAUUUUCCGUAUCUGC | 2663 | GCAGAUACGGAAAAUGGAA | | [19-37] 5'UTR | [19-37] 5'UTR |
| 241 | 2381 | AUCGCAUCUUGUGUCGCUG | 2664 | CAGCGACACAAGAUGCGAU | Ms,GP,Chn,Chp | [548-566] ORF | [787-805] 3'UTR |
| 242 | 2382 | UACGACAUGAACGGCUGUU | 2665 | AACAGCCGUUCAUGUCGUA | Chp | [298-316] ORF | [298-316] ORF |
| 243 | 2383 | CUCAUUUUUUUCGCUUUGC | 2666 | GCAAAGCGAAAAAAAUGAG | | [51-69] 5'UTR | [51-69] 5'UTR |
| 244 | 2384 | CUUAACUGCAUCCAGCCUG | 2667 | CAGGCUGGAUGCAGUUAAG | | [698-716] 3'UTR | [937-955] 3'UTR |
| 245 | 2385 | GGAAUCCGAAGUUGGAACC | 2668 | GGUUCCAACUUCGGAUUCC | | [432-450] ORF | [432-450] ORF |
| 246 | 2386 | ACAUCAGGGACCUUCAGU | 2669 | ACUGAAGGUCCCUGAUGA | | [400-418] ORF | [400-418] ORF |
| 247 | 2387 | UUACUCACGCCUCAAGGAG | 2670 | CUCCUUGAGGCGUGAGUAA | | [315-333] ORF | [315-333] ORF |
| 248 | 2388 | AGUCACCAGAGACUUUAGG | 2671 | CCUAAAGUCUCUGGUGACU | Chp | [771-789] 3'UTR | [1010-1028] 3'UTR |
| 249 | 2389 | GACGAUCGCAUCUUGUGUC | 2672 | GACACAAGAUGCGAUCGUC | Ms,GP,Chn,Chp | [544-562] ORF | [783-801] 3'UTR |
| 250 | 2390 | AACUCGGAAUCCGAAGUUG | 2673 | CAACUUCGGAUUCCGAGUU | Chp | [427-445] ORF | [427-445] ORF |
| 251 | 2391 | AUCAGGGACCUUCAGUUGG | 2674 | CCAACUGAAGGUCCCUGAU | | [403-421] ORF | [403-421] ORF |
| 252 | 2392 | CUGCUCUACGACAUGAACG | 2675 | CGUUCAUGUCGUAGAGCAG | Rat,Ms,GP,Chn,Chp | [292-310] ORF | [292-310] ORF |
| 253 | 2393 | UCCACCUCAUUUUUUUCGC | 2676 | GCGAAAAAAAUGAGGUGGA | | [46-64] 5'UTR | [46-64] 5'UTR |
| 254 | 2394 | AUGGUCACGUUUGGUGCUU | 2677 | AAGCACCAAACGUGACCAU | Chp | [844-862] 3'UTR | [1083-1101] 3'UTR |
| 255 | 2395 | UGAACGGCUGUUACUCACG | 2678 | CGUGAGUAACAGCCGUUCA | Chp | [305-323] ORF | [305-323] ORF |
| 256 | 2396 | UUCUGUUUCAGCCAGUCGC | 2679 | GCGACUGGCUGAAACAGAA | | [73-91] 5'UTR | [73-91] 5'UTR |
| 257 | 2397 | UUUGCCCAUUCUGUUUCAG | 2680 | CUGAAACAGAAUGGGCAAA | Chp | [65-83] 5'UTR | [65-83] 5'UTR |
| 258 | 2398 | UAUAUUACAAUGAUCACCG | 2681 | CGGUGAUCAUUGUAAUAUA | Chp | [894-912] 3'UTR | [1133-1151] 3'UTR |
| 259 | 2399 | GUCACGUUUGGUGCUUCUC | 2682 | GAGAAGCACCAAACGUGAC | Chp | [847-865] 3'UTR | [1086-1104] 3'UTR |
| 260 | 2400 | UUUCGCUUUGCCCAUUCUG | 2683 | CAGAAUGGGCAAAGCGAAA | Chp | [59-77] 5'UTR | [59-77] 5'UTR |
| 261 | 2401 | GAAUCCGAAGUUGGAACCC | 2684 | GGGUUCCAACUUCGGAUUC | | [433-451] ORF | [433-451] ORF |
| 262 | 2402 | UUUACAAUAGUUCUGUGGG | 2685 | CCCACAGAACUAUUGUAAA | Chp | [927-945] 3'UTR | [1166-1184] 3'UTR |
| 263 | 2403 | UUCAGUUGGAGCUGAACUC | 2686 | GAGUUCAGCUCCAACUGAA | | [413-431] ORF | [413-431] ORF |
| 264 | 2404 | UUGGUGCUUCUCAGAUUUC | 2687 | GAAAUCUGAGAAGCACCAA | Chp | [854-872] 3'UTR | [1093-1111] 3'UTR |
| 265 | 2405 | AGCAAGGUGGAGAUUCUCC | 2688 | GGAGAAUCUCCACCUUGCU | Chp | [367-385] ORF | [367-385] ORF |
| 266 | 2406 | AUUACGUGCUCUGUGGGUC | 2689 | GACCCACAGAGCACGUAAU | Chp | [619-637] 3'UTR | [858-876] 3'UTR |
| 267 | 2407 | ACGAUCGCAUCUUGUGUCG | 2690 | CGACACAAGAUGCGAUCGU | Ms,GP,Chn,Chp | [545-563] ORF | [784-802] 3'UTR |
| 268 | 2408 | AAGGUGGAGAUUCUCCAGC | 2691 | GCUGGAGAAUCUCCACCUU | Chp | [370-388] ORF | [370-388] ORF |
| 269 | 2409 | AAAAUGGUCACGUUUGGUG | 2692 | CACCAAACGUGACCAUUUU | Chp | [841-859] 3'UTR | [1080-1098] 3'UTR |
| 270 | 2410 | UGCACACCUACUAGUCACC | 2693 | GGUGACUAGUAGGUGUGCA | Chp | [759-777] 3'UTR | [998-1016] 3'UTR |
| 271 | 2411 | UCAGUUGGAGCUGAACUCG | 2694 | CGAGUUCAGCUCCAACUGA | | [414-432] ORF | [414-432] ORF |
| 272 | 2412 | UUUUACAAUAGUUCUGUGG | 2695 | CCACAGAACUAUUGUAAAA | Chp | [926-944] 3'UTR | [1165-1183] 3'UTR |
| 273 | 2413 | AUCUUGUGUCGCUGAAGCG | 2696 | CGCUUCAGCGACACAAGAU | Chp | [553-571] ORF+3'UTR | [792-810] 3'UTR |
| 274 | 2414 | AUUCUGUUUCAGCCAGUCG | 2697 | CGACUGGCUGAAACAGAAU | | [72-90] 5'UTR | [72-90] 5'UTR |
| 275 | 2415 | AUCAUGAAAGUCGCCAGUG | 2698 | CACUGGCGACUUUCAUGAU | Chp | [97-115] 5'UTR+ORF | [97-115] 5'UTR+ORF |
| 276 | 2416 | UUUUUCGCUUUGCCCAUUC | 2699 | GAAUGGGCAAAGCGAAAAA | | [57-75] 5'UTR | [57-75] 5'UTR |
| 277 | 2417 | AUUUUCCGUAUCUGCUUCG | 2700 | CGAAGCAGAUACGGAAAAU | Chp | [23-41] 5'UTR | [23-41] 5'UTR |
| 278 | 2418 | AUCGACUACAUCAGGGACC | 2701 | GGUCCCUGAUGUAGUCGAU | Rat,Ms,Chn,Chp | [394-412] ORF | [394-412] ORF |
| 279 | 2419 | UUUCCGUAUCUGCUUCGGG | 2702 | CCCGAAGCAGAUACGGAAA | Chp | [25-43] 5'UTR | [25-43] 5'UTR |
| 280 | 2420 | UUGCCCAUUCUGUUUCAGC | 2703 | GCUGAAACAGAAUGGGCAA | Chp | [66-84] 5'UTR | [66-84] 5'UTR |
| 281 | 2421 | AUUCUCCAGCACGUCAUCG | 2704 | CGAUGACGUGCUGGAGAAU | Chp | [379-397] ORF | [379-397] ORF |
| 282 | 2422 | UUUUCCGUAUCUGCUUCGG | 2705 | CCGAAGCAGAUACGGAAAA | Chp | [24-42] 5'UTR | [24-42] 5'UTR |
| 283 | 2423 | UUCCACCUCAUUUUUUUCG | 2706 | CGAAAAAAAUGAGGUGGAA | | [45-63] 5'UTR | [45-63] 5'UTR |

Table A4 ID2 - inhibitor of DNA binding 2

| No. | SEQ ID NO. | Sense siRNA | SEQ ID NO. | AntiSense siRNA | Other Sp | Human-33946335 ORF:184-588 |
|---|---|---|---|---|---|---|

FIGURE 4 Continued

| # | | | | | | |
|---|---|---|---|---|---|---|
| 1 | 2707 | UGCUAUACAACAUGAACGA | 3207 | UCGUUCAUGUUGUAUAGCA | | [287-305] ORF |
| 2 | 2708 | AUGAACGACUGCUACUCCA | 3208 | UGGAGUAGCAGUCGUUCAU | Rat,Ms,GP,Chn | [298-316] ORF |
| 3 | 2709 | ACAACAUGAACGACUGCUA | 3209 | UAGCAGUCGUUCAUGUUGU | Rat,Ms,GP | [293-311] ORF |
| 4 | 2710 | UGUUAUAACUGAACCCAAA | 3210 | UUUGGGUUCAGUUAUAACA | Ms | [1284-1302] 3'UTR |
| 5 | 2711 | GCCUGCUAUACAACAUGAA | 3211 | UUCAUGUUGUAUAGCAGGC | | [284-302] ORF |
| 6 | 2712 | CCUUCUGAGUUAAUGUCAA | 3212 | UUGACAUUAACUCAGAAGG | | [544-562] ORF |
| 7 | 2713 | GUCUAUUUCUGCAUUCAAA | 3213 | UUUGAAUGCAGAAAUAGAC | | [1115-1133] 3'UTR |
| 8 | 2714 | CGAAAACGUUAAAAUCACA | 3214 | UGUGAUUUUAACGUUUUCG | | [874-892] 3'UTR |
| 9 | 2715 | UGAACGACUGCUACUCCAA | 3215 | UUGGAGUAGCAGUCGUUCA | Rat,Ms,GP,Chn | [299-317] ORF |
| 10 | 2716 | CAACAUGAACGACUGCUAC | 3216 | GUAGCAGUCGUUCAUGUUG | Rat,Ms,GP | [294-312] ORF |
| 11 | 2717 | CUAUACAACAUGAACGACU | 3217 | AGUCGUUCAUGUUGUAUAG | | [289-307] ORF |
| 12 | 2718 | UAUACAACAUGAACGACUG | 3218 | CAGUCGUUCAUGUUGUAUA | | [290-308] ORF |
| 13 | 2719 | CGUUAAAAUCACAAGGAAU | 3219 | AUUCCUUGUGAUUUUAACG | | [880-898] 3'UTR |
| 14 | 2720 | GAAGGAAAACUAAGAAUGA | 3220 | UCAUUCUUAGUUUUCCUUC | | [735-753] 3'UTR |
| 15 | 2721 | GAAUCUUUUAAGUGCUGAA | 3221 | UUCAGCACUUAAAAGAUUC | | [649-667] 3'UTR |
| 16 | 2722 | GACUUUGCCUUUUUUCAAA | 3222 | UUUGAAAAAAGGCAAAGUC | | [914-932] 3'UTR |
| 17 | 2723 | CGGUCAGCAUGAAAGCCUU | 3223 | AAGGCUUUCAUGCUGACCG | | [176-194] 5'UTR+ORF |
| 18 | 2724 | ACGUUAAAAUCACAAGGAA | 3224 | UUCCUUGUGAUUUUAACGU | | [879-897] 3'UTR |
| 19 | 2725 | GGGUGUUCUCUUACUUGGA | 3225 | UCCAAGUAAGAGAACACCC | | [765-783] 3'UTR |
| 20 | 2726 | CCUACUGAAUGCUGUGUAU | 3226 | AUACACAGCAUUCAGUAGG | Ms | [1016-1034] 3'UTR |
| 21 | 2727 | GAAGUCUUUUGGCUAGAAA | 3227 | UUUCUGACCAAAAGACUUC | | [979-997] 3'UTR |
| 22 | 2728 | CCAGUAUUCAGUCACUUAA | 3228 | UUAAGUGACUGAAUACUGG | | [958-976] 3'UTR |
| 23 | 2729 | CAGUAUUCAGUCACUUAAA | 3229 | UUUAAGUGACUGAAUACUG | | [959-977] 3'UTR |
| 24 | 2730 | CAAGGAAUUGCCCAAUCUA | 3230 | UAGAUUGGGCAAUUCCUUG | | [891-909] 3'UTR |
| 25 | 2731 | GAACGACUGCUACUCCAAG | 3231 | CUUGGAGUAGCAGUCGUUC | Rat,Ms,GP,Chn | [300-318] ORF |
| 26 | 2732 | GGAGCGAAAACGUUAAAAU | 3232 | AUUUUAACGUUUUCGCUCC | | [870-888] 3'UTR |
| 27 | 2733 | GAACCCAAAUAAAUACAAG | 3233 | CUUGUAUUUAUUUGGGUUC | | [1294-1312] 3'UTR |
| 28 | 2734 | GCUAUACAACAUGAACGAC | 3234 | GUCGUUCAUGUUGUAUAGC | | [288-306] ORF |
| 29 | 2735 | AAGGAAUUGCCCAAUCUAA | 3235 | UUAGAUUGGGCAAUUCCUU | | [892-910] 3'UTR |
| 30 | 2736 | AGAAGGUGAGCAAGAUGGA | 3236 | UCCAUCUUGCUCACCUUCU | GP,Chn | [353-371] ORF |
| 31 | 2737 | ACUGCUACUCCAAGCUCAA | 3237 | UUGAGCUUGGAGUAGCAGU | Rat,Ms | [305-323] ORF |
| 32 | 2738 | GGGAGCGAAAACGUUAAAA | 3238 | UUUUAACGUUUUCGCUCCC | | [869-887] 3'UTR |
| 33 | 2739 | GGACUGUGAUAUUCGUUAU | 3239 | AUAACGAAUAUCACAGUCC | | [781-799] 3'UTR |
| 34 | 2740 | CCAGUGCUUUGAUUUUUAU | 3240 | AUAAAAAUCAAAGCACUGG | | [1258-1276] 3'UTR |
| 35 | 2741 | CAUGAACGACUGCUACUCC | 3241 | GGAGUAGCAGUCGUUCAUG | Rat,Ms,GP | [297-315] ORF |
| 36 | 2742 | CCUUUUUGACACAAGCCUA | 3242 | UAGGCUUGUGUCAAAAAGG | | [1001-1019] 3'UTR |
| 37 | 2743 | GUCCUUGCAGGCUUCUGAA | 3243 | UUCAGAAGCCUGCAAGGAC | | [522-540] ORF |
| 38 | 2744 | UGAGGUCCGUUAGGAAAAA | 3244 | UUUUUCCUAACGGACCUCA | Rat,Ms | [203-221] ORF |
| 39 | 2745 | GGAAAACUAAGAAUGAUCA | 3245 | UGAUCAUUCUUAGUUUUCC | | [738-756] 3'UTR |
| 40 | 2746 | GUGAGGUCCGUUAGGAAAA | 3246 | UUUUCCUAACGGACCUCAC | Rat,Ms | [202-220] ORF |
| 41 | 2747 | GUUGGAAGGUUUUCUUUAU | 3247 | AUAAAGAAAACCUUCCAAC | Ms | [833-851] 3'UTR |
| 42 | 2748 | CAUUUCACAAGGAGGACAA | 3248 | UUGUCCUCCUUGUGAAAUG | | [681-699] 3'UTR |
| 43 | 2749 | GGAAAAACAGCCUGUCGGA | 3249 | UCCGACAGGCUGUUUUUCC | Rat,Ms | [215-233] ORF |
| 44 | 2750 | AGGUGAGCAAGAUGGAAAU | 3250 | AUUUCCAUCUUGCUCACCU | GP,Chn | [356-374] ORF |
| 45 | 2751 | GGUGAUUGCCUGCUUUAUU | 3251 | AAUAAAGCAGGCAAUCACC | | [1231-1249] 3'UTR |
| 46 | 2752 | UGAUGUACUUAUUCAUGCU | 3252 | AGCAUGAAUAAGUACAUCA | | [1141-1159] 3'UTR |
| 47 | 2753 | CUUGUAUAGUGGCAGAGAU | 3253 | AUCUCUGCCACUAUACAAG | | [1096-1114] 3'UTR |
| 48 | 2754 | CCUUGUGAACUCUUUAAUU | 3254 | AAUUAAAGAGUUCACAAGG | | [1069-1087] 3'UTR |
| 49 | 2755 | AGCCUGCUAUACAACAUGA | 3255 | UCAUGUUGUAUAGCAGGCU | | [283-301] ORF |
| 50 | 2756 | GCCCUUUCUGCAGUUGGAA | 3256 | UUCCAACUGCAGAAAGGGC | | [821-839] 3'UTR |
| 51 | 2757 | CAACAACAAAUUCACGAAA | 3257 | UUCCGUGAAUUUGUUGUUG | | [633-651] 3'UTR |
| 52 | 2758 | CUGAAUAAAGCGGUGUUCA | 3258 | AUGAACACCGCUUAUUCAG | | [585-603] ORF+3'UTR |
| 53 | 2759 | GAGUUAAUGUCAAAUGACA | 3259 | UGUCAUUUGACAUUAACUC | | [550-568] ORF |
| 54 | 2760 | AUGUUAUAACUGAACCCAA | 3260 | UUGGGUUCAGUUAUAACAU | Ms | [1283-1301] 3'UTR |
| 55 | 2761 | UGUCUAUUUCUGCAUUCAA | 3261 | UUGAAUGCAGAAAUAGACA | | [1114-1132] 3'UTR |
| 56 | 2762 | GCGUGAAUACCAGAAGGAU | 3262 | AUCCUUCUGGUAUUCACGC | | [939-957] 3'UTR |
| 57 | 2763 | CAAAGGUGGAGCGUGAAUA | 3263 | UAUUCACGCUCCACCUUUG | | [929-947] 3'UTR |
| 58 | 2764 | CCUGCUAUACAACAUGAAC | 3264 | GUUCAUGUUGUAUAGCAGG | | [285-303] ORF |
| 59 | 2765 | GAUGUACUUAUUCAUGCUA | 3265 | UAGCAUGAAUAAGUACAUC | | [1142-1160] 3'UTR |
| 60 | 2766 | GAAGGAUCCAGUAUUCAGU | 3266 | ACUGAAUACUGGAUCCUUC | | [951-969] 3'UTR |
| 61 | 2767 | ACCAGUGCUUUGAUUUUUA | 3267 | UAAAAAUCAAAGCACUGGU | | [1257-1275] 3'UTR |
| 62 | 2768 | GGACCAGUGCUUUGAUUUU | 3268 | AAAAAUCAAAGCACUGGUCC | | [1255-1273] 3'UTR |
| 63 | 2769 | UGUGUUUAUUGAAUGGUGA | 3269 | UCACCAUUCAAUAAACACA | | [1217-1235] 3'UTR |
| 64 | 2770 | GACUGCUACUCCAAGCUCA | 3270 | UGAGCUUGGAGUAGCAGUC | Rat,Ms | [304-322] ORF |
| 65 | 2771 | UCUGCAUUCAAAAGUGUAA | 3271 | UUACACUUUUGAAUGCAGA | | [1122-1140] 3'UTR |
| 66 | 2772 | CUUUGCACAACAACAACAA | 3272 | UUGUUGUUGUUGUGCAAAG | | [617-635] 3'UTR |
| 67 | 2773 | AAUGUCAAAUGACAGCAAA | 3273 | UUUGCUGUCAUUUGACAUU | | [555-573] ORF |
| 68 | 2774 | GCUUUAUUUCAGAGGACCA | 3274 | UGGUCCUCUGAAAUAAAGC | | [1242-1260] 3'UTR |

FIGURE 4 Continued

| | | | | | |
|---|---|---|---|---|---|
| 69 | 2775 | ACUGAAUGCUGUGUAUAUA | 3275 | UAUAUACACAGCAUUCAGU | Ms | [1019-1037] 3'UTR |
| 70 | 2776 | ACCCGAUGAGCCUGCUAUA | 3276 | UAUAGCAGGCUCAUCGGGU | | [275-293] ORF |
| 71 | 2777 | AGAGGACCAGUGCUUUGAU | 3277 | AUCAAAGCACUGGUCCUCU | | [1252-1270] 3'UTR |
| 72 | 2778 | AAACCUUGUGAACUCUUUA | 3278 | UAAAGAGUUCACAAGGUUU | | [1066-1084] 3'UTR |
| 73 | 2779 | AACAUGAACGACUGCUACU | 3279 | AGUAGCAGUCGUUCAUGUU | Rat,Ms,GP | [295-313] ORF |
| 74 | 2780 | AGUUGGAAGGUUUUCUUUA | 3280 | UAAAGAAAACCUUCCAACU | Ms | [832-850] 3'UTR |
| 75 | 2781 | CUUGGACUGUGAUAUUCGU | 3281 | ACGAAUAUCACAGUCCAAG | | [778-796] 3'UTR |
| 76 | 2782 | CCAGGGUGUUCUCUUACUU | 3282 | AAGUAAGAGAACACCCUGG | | [762-780] 3'UTR |
| 77 | 2783 | CACAAGGAGGACAAGUUGA | 3283 | UCAACUUGUCCUCCUUGUG | | [686-704] 3'UTR |
| 78 | 2784 | ACAUGAACGACUGCUACUC | 3284 | GAGUAGCAGUCGUUCAUGU | Rat,Ms,GP | [296-314] ORF |
| 79 | 2785 | GCAAGAUGGAAAUCCUGCA | 3285 | UGCAGGAUUUCCAUCUUGC | | [362-380] ORF |
| 80 | 2786 | GAAACCUUGUGAACUCUUU | 3286 | AAAGAGUUCACAAGGUUUC | | [1065-1083] 3'UTR |
| 81 | 2787 | GCAGUUGGAAGGUUUUCUU | 3287 | AAGAAAACCUUCCAACUGC | | [830-848] 3'UTR |
| 82 | 2788 | CUAUUGUCAGCCUGCAUCA | 3288 | UGAUGCAGGCUGACAAUAG | | [434-452] ORF |
| 83 | 2789 | CCACUAUUGUCAGCCUGCA | 3289 | UGCAGGCUGACAAUAGUGG | | [431-449] ORF |
| 84 | 2790 | AGAGAUGUCUAUUUCUGCA | 3290 | UGCAGAAAUAGACAUCUCU | | [1109-1127] 3'UTR |
| 85 | 2791 | CUGAAUGCUGUGUAUAUAU | 3291 | AUAUAUACACAGCAUUCAG | Ms | [1020-1038] 3'UTR |
| 86 | 2792 | UUGACACAAGCCUACUGAA | 3292 | UUCAGUAGGCUUGUGUCAA | | [1006-1024] 3'UTR |
| 87 | 2793 | UGCACAACAACAACAACAA | 3293 | UUGUUGUUGUUGUUGUGCA | | [620-638] 3'UTR |
| 88 | 2794 | GUUAUAACUGAACCCAAAU | 3294 | AUUUGGGUUCAGUUAUAAC | Ms | [1285-1303] 3'UTR |
| 89 | 2795 | UUGAGUGAAACCUUGUGAA | 3295 | UUCACAAGGUUUCACUCAA | | [1059-1077] 3'UTR |
| 90 | 2796 | UUUCAAAGGUGGAGCGUGA | 3296 | UCACGCUCCACCUUUGAAA | | [926-944] 3'UTR |
| 91 | 2797 | GAAUGAUCAUCUUCCCAGG | 3297 | CCUGGGAAGAUGAUCAUUC | | [748-766] 3'UTR |
| 92 | 2798 | AAAGCACUGUGUGGCUGAA | 3298 | UUCAGCCACACAGUGCUUU | | [571-589] ORF+3'UTR |
| 93 | 2799 | UUGUCAGCCUGCAUCACCA | 3299 | UGGUGAUGCAGGCUGACAA | | [437-455] ORF |
| 94 | 2800 | AGAUGGAAAUCCUGCAGCA | 3300 | UGCUGCAGGAUUUCCAUCU | Rat,Ms | [365-383] ORF |
| 95 | 2801 | GAGGACCAGUGCUUUGAUU | 3301 | AAUCAAAGCACUGGUCCUC | | [1253-1271] 3'UTR |
| 96 | 2802 | GAUCCAGUAUUCAGCACU | 3302 | AGUGCUGAAUACUGGAUC | | [955-973] 3'UTR |
| 97 | 2803 | GGUCCGUUAGGAAAAACAG | 3303 | CUGUUUUCCUAACGGACC | Rat,Ms | [206-224] ORF |
| 98 | 2804 | GUGAUUGCCUGCUUUAUUU | 3304 | AAAUAAAGCAGGCAAUCAC | | [1232-1250] 3'UTR |
| 99 | 2805 | GAAUGGUGAUUGCCUGCUU | 3305 | AAGCAGGCAAUCACCAUUC | | [1227-1245] 3'UTR |
| 100 | 2806 | GUGUUUAUUGAAUGGUGAU | 3306 | AUCACCAUUCAAUAAACAC | | [1218-1236] 3'UTR |
| 101 | 2807 | AGACUUUGCCUUUUUUCAA | 3307 | UUGAAAAAAGGCAAAGUCU | | [913-931] 3'UTR |
| 102 | 2808 | UCUCUUACUUGGACUGUGA | 3308 | UCACAGUCCAAGUAAGAGA | | [771-789] 3'UTR |
| 103 | 2809 | GGCAGAGAUGUCUAUUUCU | 3309 | AGAAAUAGACAUCUCUGCC | | [1106-1124] 3'UTR |
| 104 | 2810 | CAAAGCACUGUGUGGCUGA | 3310 | UCAGCCACACAGUGCUUUG | | [570-588] ORF |
| 105 | 2811 | CAAGCCUACUGAAUGCUGU | 3311 | ACAGCAUUCAGUAGGCUUG | | [1012-1030] 3'UTR |
| 106 | 2812 | UGGAGCGUGAAUACCAGAA | 3312 | UUCUGGUAUUCACGCUCCA | | [935-953] 3'UTR |
| 107 | 2813 | UUCCCAGGGUGUUCUCUUA | 3313 | UAAGAGAACACCCUGGGAA | | [759-777] 3'UTR |
| 108 | 2814 | UAAUGUCAAAUGACAGCAA | 3314 | UUGCUGUCAUUUGACAUUA | | [554-572] ORF |
| 109 | 2815 | CAGAGGACCAGUGCUUUGA | 3315 | UCAAAGCACUGGUCCUCUG | | [1251-1269] 3'UTR |
| 110 | 2816 | GGAGCGUGAAUACCAGAAG | 3316 | CUUCUGGUAUUCACGCUCC | | [936-954] 3'UTR |
| 111 | 2817 | AGCGAAAACGUUAAAAUCA | 3317 | UGAUUUUAACGUUUUCGCU | | [872-890] 3'UTR |
| 112 | 2818 | GAGCGAAAACGUUAAAAUC | 3318 | GAUUUUAACGUUUUCGCUC | | [871-889] 3'UTR |
| 113 | 2819 | CAGUUGGAAGGUUUUCUUU | 3319 | AAAGAAAACCUUCCAACUG | Ms | [831-849] 3'UTR |
| 114 | 2820 | UGGACUGUGAUAUUCGUUA | 3320 | UAACGAAUAUCACAGUCCA | | [780-796] 3'UTR |
| 115 | 2821 | CCCAGGGUGUUCUCUUACU | 3321 | AGUAAGAGAACACCCUGGG | | [761-779] 3'UTR |
| 116 | 2822 | GGAAUCUUUUAAAGUGCUGA | 3322 | UCAGCACUUUAAAAGAUUCC | | [648-666] 3'UTR |
| 117 | 2823 | CAAAUGACAGCAAAGCACU | 3323 | AGUGCUUUGCUGUCAUUUG | Chn | [560-578] ORF |
| 118 | 2824 | GAUUGCCUGCUUUAUUUCA | 3324 | UGAAAUAAAGCAGGCAAUC | | [1234-1252] 3'UTR |
| 119 | 2825 | GUUGUAAACUUAACCCUUU | 3325 | AAAGGGUUAAGUUUACAAC | Ms | [1180-1198] 3'UTR |
| 120 | 2826 | AACCUUGUGAACUCUUUAA | 3326 | UUAAAGAGUUCACAAGGUU | | [1067-1085] 3'UTR |
| 121 | 2827 | UACUGAAUGCUGUGUAUAU | 3327 | AUAUACACAGCAUUCAGUA | Ms | [1018-1036] 3'UTR |
| 122 | 2828 | AAGUCUUUUGGUCAGAAAU | 3328 | AUUUCUGACCAAAAGACUU | | [980-998] 3'UTR |
| 123 | 2829 | UGCCCUUUCUGCAGUUGGA | 3329 | UCCAACUGCAGAAAGGGCA | | [820-838] 3'UTR |
| 124 | 2830 | UGGAAGGAAAACUAAGAAU | 3330 | AUUCUUAGUUUUCCUUCCA | | [733-751] 3'UTR |
| 125 | 2831 | AGUUGUAAACUUAACCCUU | 3331 | AAGGGUUAAGUUUACAACU | Ms | [1179-1197] 3'UTR |
| 126 | 2832 | GCCUACUGAAUGCUGUGUA | 3332 | UACACAGCAUUCAGUAGGC | Ms | [1015-1033] 3'UTR |
| 127 | 2833 | AAAUGAAGUCUUUUGGUCA | 3333 | UGACCAAAAGACUUCAUUU | | [975-993] 3'UTR |
| 128 | 2834 | CAGACUUUGCCUUUUUUCA | 3334 | UGAAAAAAGGCAAAGUCUG | | [912-930] 3'UTR |
| 129 | 2835 | ACAAAUUCACGGAAUCUUU | 3335 | AAAGAUUCCGUGAAUUUGU | | [638-656] 3'UTR |
| 130 | 2836 | GGUGUUCAUGAUUUCUUUU | 3336 | AAAAGAAAUCAUGAACACC | | [595-613] 3'UTR |
| 131 | 2837 | AGGUCCGUUAGGAAAAACA | 3337 | UGUUUUUCCUAACGGACCU | Rat,Ms | [205-223] ORF |
| 132 | 2838 | ACUACAUCUUGGACCUGCA | 3338 | UGCAGGUCCAAGAUGUAGU | | [392-410] ORF |
| 133 | 2839 | CCUGCUUUAUUUCAGAGGA | 3339 | UCCUCUGAAAUAAAGCAGG | | [1239-1257] 3'UTR |
| 134 | 2840 | AGAUGUCUAUUUCUGCAUU | 3340 | AAUGCAGAAAUAGACAUCU | | [1111-1129] 3'UTR |
| 135 | 2841 | CUAUUUGAGUGAAACCUUG | 3341 | CAAGGUUUCACUCAAAUAG | | [1055-1073] 3'UTR |
| 136 | 2842 | GUGGAGCGUGAAUACCAGA | 3342 | UCUGGUAUUCACGCUCCAC | | [934-952] 3'UTR |

FIGURE 4 Continued

| | | | | | | | |
|---|---|---|---|---|---|---|---|
| 137 | 2843 | GCCUUUUUCAAAGGUGGA | 3343 | UCCACCUUUGAAAAAAGGC | | [920-938] 3'UTR |
| 138 | 2844 | CUCUUACUUGGACUGUGAU | 3344 | AUCACAGUCCAAGUAAGAG | | [772-790] 3'UTR |
| 139 | 2845 | UCAUCGACUACAUCUUGGA | 3345 | UCCAAGAUGUAGUCGAUGA | | [386-404] ORF |
| 140 | 2846 | GAACAAGAAGGUGAGCAAG | 3346 | CUUGCUCACCUUCUUGUUC | GP,Chn | [348-366] ORF |
| 141 | 2847 | CUGCAUUCAAAAGUGUAAU | 3347 | AUUACACUUUUGAAUGCAG | | [1123-1141] 3'UTR |
| 142 | 2848 | AGGUGGAGCGUGAAUACCA | 3348 | UGGUAUUCACGCUCCACCU | | [932-950] 3'UTR |
| 143 | 2849 | UCUUACUUGGACUGUGAUA | 3349 | UAUCACAGUCCAAGUAAGA | | [773-791] 3'UTR |
| 144 | 2850 | CCAUUUCACAAGGAGGACA | 3350 | UGUCCUCCUUGUGAAAUGG | | [680-698] 3'UTR |
| 145 | 2851 | CCCUUCUGAGUUAAUGUCA | 3351 | UGACAUUAACUCAGAAGGG | | [543-561] ORF |
| 146 | 2852 | UCCAGUAUUCAGUCACUUA | 3352 | UAAGUGACUGAAUACUGGA | | [957-975] 3'UTR |
| 147 | 2853 | UCUGCAGUUGGAAGGUUUU | 3353 | AAAACCUUCCAACUGCAGA | | [827-845] 3'UTR |
| 148 | 2854 | GACUGUGAUAUUCGUUAUU | 3354 | AAUAACGAAUAUCACAGUC | | [782-800] 3'UTR |
| 149 | 2855 | CCCUCAACACGGAUAUCAG | 3355 | CUGAUAUCCGUGUUGAGGG | | [497-515] ORF |
| 150 | 2856 | GCUACUCCAAGCUCAAGGA | 3356 | UCCUUGAGCUUGGAGUAGC | Rat,Ms | [308-326] ORF |
| 151 | 2857 | GUCUUUUGGUCAGAAAUUA | 3357 | UAAUUUCUGACCAAAAGAC | | [982-1000] 3'UTR |
| 152 | 2858 | AUACCAGAAGGAUCCAGUA | 3358 | UACUGGAUCCUUCUGGUAU | | [945-963] 3'UTR |
| 153 | 2859 | UCUUUUAAGUGCUGAACUU | 3359 | AAGUUCAGCACUUAAAAGA | | [652-670] 3'UTR |
| 154 | 2860 | ACAACAACAAAUUCACGGA | 3360 | UCCGUGAAUUUGUUGUUGU | | [632-650] 3'UTR |
| 155 | 2861 | AAAUCCUGCAGCACGUCAU | 3361 | AUGACGUGCUGCAGGAUUU | Rat,Ms | [371-389] ORF |
| 156 | 2862 | CCCAAAUAAAUACAAGUUC | 3362 | GAACUUGUAUUUAUUUGGG | | [1297-1315] 3'UTR |
| 157 | 2863 | CUACUGAAUGCUGUGUAUA | 3363 | UAUACACAGCAUUCAGUAG | Ms | [1017-1035] 3'UTR |
| 158 | 2864 | GGUCAGAAAUUACCUUUUU | 3364 | AAAAAGGUAAUUUCUGACC | | [989-1007] 3'UTR |
| 159 | 2865 | UGAAGUCUUUUGGUCAGAA | 3365 | UUCUGACCAAAAGACUUCA | | [978-996] 3'UTR |
| 160 | 2866 | AGAAGGAUCCAGUAUUCAG | 3366 | CUGAAUACUGGAUCCUUCU | | [950-968] 3'UTR |
| 161 | 2867 | UCAAAGGUGGAGCGUGAAU | 3367 | AUUCACGCUCCACCUUUGA | | [928-946] 3'UTR |
| 162 | 2868 | UUCAAGGUGGAGCGUGAA | 3368 | UUCACGCUCCACCUUUGAA | | [927-945] 3'UTR |
| 163 | 2869 | GGAAGGAAAACUAAGAAUG | 3369 | CAUUCUUAGUUUUCCUUCC | | [734-752] 3'UTR |
| 164 | 2870 | GCUGAAUAAGCGGUGUUCA | 3370 | UGAACACCGCUUAUUCAGC | | [584-602] ORF+3'UTR |
| 165 | 2871 | CACUGUGUGGCUGAAUAAG | 3371 | CUUAUUCAGCCACACAGUG | | [575-593] ORF+3'UTR |
| 166 | 2872 | CAGGCUUCUGAAUUCCCUU | 3372 | AAGGGAAUUCAGAAGCCUG | | [529-547] ORF |
| 167 | 2873 | GAAAUCCUGCAGCACGUCA | 3373 | UGACGUGCUGCAGGAUUUC | Rat,Ms | [370-388] ORF |
| 168 | 2874 | AAUGGUGAUUGCCUGCUUU | 3374 | AAAGCAGGCAAUCACCAUU | | [1228-1246] 3'UTR |
| 169 | 2875 | UUUCUUGUAUAGUGGCAGA | 3375 | UCUGCCACUAUACAAGAAA | Ms | [1093-1111] 3'UTR |
| 170 | 2876 | CAGAAAUUACCUUUUUGAC | 3376 | GUCAAAAAGGUAAUUUCUG | | [992-1010] 3'UTR |
| 171 | 2877 | GCAGGCUUCUGAAUUCCCU | 3377 | AGGGAAUUCAGAAGCCUGC | | [528-546] ORF |
| 172 | 2878 | UCAGCAUCCUGUCCUUGCA | 3378 | UGCAAGGACAGGAUGCUGA | Rat,Ms,GP,Chn | [512-530] ORF |
| 173 | 2879 | CACUAUUGUCAGCCUGCAU | 3379 | AUGCAGGCUGACAAUAGUG | | [432-450] ORF |
| 174 | 2880 | UCUUGUAUAGUGGCAGAGA | 3380 | UCUCUGCCACUAUACAAGA | | [1095-1113] 3'UTR |
| 175 | 2881 | AAAGGUGGAGCGUGAAUAC | 3381 | GUAUUCACGCUCCACCUUU | | [930-948] 3'UTR |
| 176 | 2882 | AUCACAAGGAAUUGCCCAA | 3382 | UUGGGCAAUUCCUUGUGAU | Ms | [887-905] 3'UTR |
| 177 | 2883 | GCGAAAACGUUAAAAUCAC | 3383 | GUGAUUUUAACGUUUUCGC | | [873-891] 3'UTR |
| 178 | 2884 | CAAAUUCACGGAAUCUUUU | 3384 | AAAAGAUUCCGUGAAUUUG | | [639-657] 3'UTR |
| 179 | 2885 | AUAUCAGCAUCCUGCCUU | 3385 | AAGGACAGGAUGCUGAUAU | | [509-527] ORF |
| 180 | 2886 | CCUCAACACGGAUAUCAGC | 3386 | GCUGAUAUCCGUGUUGAGG | | [498-516] ORF |
| 181 | 2887 | UGGAAAUCCUGCAGCACGU | 3387 | ACGUGCUGCAGGAUUUCCA | Rat,Ms | [368-386] ORF |
| 182 | 2888 | GUGUGUUUAUUGAAUGGUG | 3388 | CACCAUUCAAUAAACACAC | | [1216-1234] 3'UTR |
| 183 | 2889 | GCAUUCAAAAGUGUAAUGA | 3389 | UCAUUACACUUUUGAAUGC | | [1125-1143] 3'UTR |
| 184 | 2890 | GAGUGAAACCUUGUGAACU | 3390 | AGUUCACAAGGUUUCACUC | | [1061-1079] 3'UTR |
| 185 | 2891 | AGGAAUUGCCCAAUCUAAG | 3391 | CUUAGAUUGGGCAAUUCCU | | [893-911] 3'UTR |
| 186 | 2892 | AACCAUUUCACAAGGAGGA | 3392 | UCCUCCUUGUGAAAUGGUU | | [678-696] 3'UTR |
| 187 | 2893 | CAACCAUUUCACAAGGAGG | 3393 | CCUCCUUGUGAAAUGGUUG | | [677-695] 3'UTR |
| 188 | 2894 | GCGGUGUUCAUGAUUUCUU | 3394 | AAGAAAUCAUGAACACCGC | | [593-611] 3'UTR |
| 189 | 2895 | CCUUGCAGGCUUCUGAAUU | 3395 | AAUUCAGAAGCCUGCAAGG | | [524-542] ORF |
| 190 | 2896 | CCACCCUCAACACGGAUAU | 3396 | AUAUCCGUGUUGAGGGUGG | | [494-512] ORF |
| 191 | 2897 | ACAUCUUGGACCUGCAGAU | 3397 | AUCUGCAGGUCCAAGAUGU | Ms | [395-413] ORF |
| 192 | 2898 | CCCUUUCUGCAGUUGGAAG | 3398 | CUUCCAACUGCAGAAAGGG | | [822-840] 3'UTR |
| 193 | 2899 | UAUUCUUUGCACAACAACA | 3399 | UGUUGUUGUGCAAAGAAUA | | [613-631] 3'UTR |
| 194 | 2900 | UGUCCUUGCAGGCUUCUGA | 3400 | UCAGAAGCCUGCAAGGACA | | [521-539] ORF |
| 195 | 2901 | UCAACACGGAUAUCAGCAU | 3401 | AUGCUGAUAUCCGUGUUGA | | [500-518] ORF |
| 196 | 2902 | CUGAACCCAAAUAAAUACA | 3402 | UGUAUUUAUUUGGGUUCAG | | [1292-1310] 3'UTR |
| 197 | 2903 | CAAGUGUGUUUAUUGAAUG | 3403 | CAUUCAAUAAACACACUUG | Ms | [1213-1231] 3'UTR |
| 198 | 2904 | GAGAUGCUAUUUCUGCAU | 3404 | AUGCAGAAAUAGACAUCUC | | [1110-1128] 3'UTR |
| 199 | 2905 | GUUUUCUUGUAUAGUGGCA | 3405 | UGCCACUAUACAAGAAAAC | Ms | [1091-1109] 3'UTR |
| 200 | 2906 | ACCUUGAACUCUUUAAU | 3406 | AUUAAAGAGUUCAAGGU | | [1068-1086] 3'UTR |
| 201 | 2907 | CCCAAUCUAAGCAGACUUU | 3407 | AAAGUCUGCUUAGAUUGGG | | [901-919] 3'UTR |
| 202 | 2908 | ACUUUUAAAUGCCCUUUCU | 3408 | AGAAAGGGCAUUUAAAAGU | | [811-829] 3'UTR |
| 203 | 2909 | GUGCUGAACUUAUUUUUCA | 3409 | UGAAAAAUAAGUUCAGCAC | | [660-678] 3'UTR |
| 204 | 2910 | CGGAAUCUUUUAAGUGCUG | 3410 | CAGCACUUAAAAGAUUCCG | | [647-665] 3'UTR |

FIGURE 4 Continued

| | | | | | | |
|---|---|---|---|---|---|---|
| 205 | 2911 | GUCAAAUGACAGCAAAGCA | 3411 | UGCUUUGCUGUCAUUUGAC | Chn | [558-576] ORF |
| 206 | 2912 | UGGUGAUUGCCUGCUUUAU | 3412 | AUAAAGCAGGCAAUCACCA | | [1230-1248] 3'UTR |
| 207 | 2913 | AUGGUGAUUGCCUGCUUUA | 3413 | UAAAGCAGGCAAUCACCAU | | [1229-1247] 3'UTR |
| 208 | 2914 | GUGGCAGAGAUGUCUAUUU | 3414 | AAAUAGACAUCUCUGCCAC | | [1104-1122] 3'UTR |
| 209 | 2915 | GAGUUUUCUUGUAUAGUGG | 3415 | CCACUAUACAAGAAAACUC | Ms | [1089-1107] 3'UTR |
| 210 | 2916 | AGUCUUUUGGUCAGAAAUU | 3416 | AAUUUCUGACCAAAAGACU | | [981-999] 3'UTR |
| 211 | 2917 | AUACAACAUGAACGACUGC | 3417 | GCAGUCGUUCAUGUUGUAU | | [291-309] ORF |
| 212 | 2918 | GGUGUUCUCUUACUUGGAC | 3418 | GUCCAAGUAAGAGAACACC | | [766-784] 3'UTR |
| 213 | 2919 | CAGGGUGUUCUCUUACUUG | 3419 | CAAGUAAGAGAACACCCUG | | [763-781] 3'UTR |
| 214 | 2920 | AAAACAGCCUGUCGGACCA | 3420 | UGGUCCGACAGGCUGUUUU | Rat,Ms,GP | [218-236] ORF |
| 215 | 2921 | CACAACAACAACAACAACA | 3421 | UGUUGUUGUUGUUGUUGUG | | [622-640] 3'UTR |
| 216 | 2922 | GACCAGUGCUUUGAUUUUU | 3422 | AAAAAUCAAAGCACUGGUC | | [1256-1274] 3'UTR |
| 217 | 2923 | CAGCAUGAAAGCCUUCAGU | 3423 | ACUGAAGGCUUUCAUGCUG | Rat,Ms | [180-198] 5'UTR+ORF |
| 218 | 2924 | ACGGAAUCUUUUAAGUGCU | 3424 | AGCACUUAAAAGAUUCCGU | | [646-664] 3'UTR |
| 219 | 2925 | AACAACAAAUUCACGGAAU | 3425 | AUUCCGUGAAUUUGUUGUU | | [634-652] 3'UTR |
| 220 | 2926 | CAACAACAACAAAUUCACG | 3426 | CGUGAAUUUGUUGUUGUUG | | [630-648] 3'UTR |
| 221 | 2927 | ACAACAACAACAAAUUCAC | 3427 | GUGAAUUUGUUGUUGUUGU | | [629-647] 3'UTR |
| 222 | 2928 | AUUCUUUGCACAACAACAA | 3428 | UUGUUGUUGUGCAAAGAAU | | [614-632] 3'UTR |
| 223 | 2929 | AACAAGAAGGUGAGCAAGA | 3429 | UCUUGCUCACCUUCUGUGUU | GP,Chn | [349-367] ORF |
| 224 | 2930 | GCAUGAAAGCCUUCAGUCC | 3430 | GGACUGAAGGCUUUCAUGC | Rat,Ms | [182-200] 5'UTR+ORF |
| 225 | 2931 | UUGCCUGCUUUAUUUCAGA | 3431 | UCUGAAAUAAAGCAGGCAA | | [1236-1254] 3'UTR |
| 226 | 2932 | AGGAUCCAGUAUUCAGUCA | 3432 | UGACUGAAUACUGGAUCCU | | [953-971] 3'UTR |
| 227 | 2933 | CAGAAGGAUCCAGUAUUCA | 3433 | UGAAUACUGGAUCCUUCUG | | [949-967] 3'UTR |
| 228 | 2934 | CCAGAAGGAUCCAGUAUUC | 3434 | GAAUACUGGAUCCUUCUGG | | [948-966] 3'UTR |
| 229 | 2935 | AGCAGACUUUGCCUUUUUU | 3435 | AAAAAAGGCAAAGUCUGCU | | [910-928] 3'UTR |
| 230 | 2936 | CACGGAUAUCAGCAUCCUG | 3436 | CAGGAUGCUGAUAUCCGUG | | [504-522] ORF |
| 231 | 2937 | GAAAUUACCUUUUUGACAC | 3437 | GUGUCAAAAAGGUAAUUUC | | [994-1012] 3'UTR |
| 232 | 2938 | UGAGCCUGCUAUACAACAU | 3438 | AUGUUGUAUAGCAGGCUCA | | [281-299] ORF |
| 233 | 2939 | GAUGAGCCUGCUAUACAAC | 3439 | GUUGUAUAGCAGGCUCAUC | | [279-297] ORF |
| 234 | 2940 | CUUACUUGGACUGUGAUAU | 3440 | AUAUCACAGUCCAAGUAAG | | [774-792] 3'UTR |
| 235 | 2941 | CUUCCCAGGGUGUUCUCUU | 3441 | AAGAGAACACCCUGGGAAG | | [758-776] 3'UTR |
| 236 | 2942 | CUUUUAAGUGCUGAACUUA | 3442 | UAAGUUCAGCACUUAAAAG | | [653-671] 3'UTR |
| 237 | 2943 | GCUUCUGAAUUCCCUUCUG | 3443 | CAGAAGGGAAUUCAGAAGC | | [532-550] ORF |
| 238 | 2944 | GAGCAAGAUGGAAAUCCUG | 3444 | CAGGAUUUCCAUCUUGCUC | | [360-378] ORF |
| 239 | 2945 | AGGACCAGUGCUUUGAUUU | 3445 | AAAUCAAAGCACUGGUCCU | | [1254-1272] 3'UTR |
| 240 | 2946 | CUGCUUUAUUUCAGAGGAC | 3446 | GUCCUCUGAAAUAAAGCAG | | [1240-1258] 3'UTR |
| 241 | 2947 | UAGUGGCAGAGAUGUCUAU | 3447 | AUAGACAUCUCUGCCACUA | | [1102-1120] 3'UTR |
| 242 | 2948 | UCUAUUUGAGUGAAACCUU | 3448 | AAGGUUUCACUCAAAUAGA | | [1054-1072] 3'UTR |
| 243 | 2949 | GUCAGAAAUUACCUUUUUG | 3449 | CAAAAAGGUAAUUUCUGAC | | [990-1008] 3'UTR |
| 244 | 2950 | CGUGAAUACCAGUAAGGAUC | 3450 | GAUCCUUACUGGUAUUCACG | | [940-958] 3'UTR |
| 245 | 2951 | AUUGCCCAAUCUAAGCAGA | 3451 | UCUGCUUAGAUUGGGCAAU | | [897-915] 3'UTR |
| 246 | 2952 | AACGUUAAAAUCACAAGGA | 3452 | UCCUUGUGAUUUUAACGUU | | [878-896] 3'UTR |
| 247 | 2953 | UAUAUACUAUUCCCACCAU | 3453 | AUGGUGGGAAUAGUAUAUA | Ms | [849-867] 3'UTR |
| 248 | 2954 | CUUUAUAUACUAUUCCCAC | 3454 | GUGGGAAUAGUAUAUAAAG | Ms | [846-864] 3'UTR |
| 249 | 2955 | UUACUUGGACUGUGAUAUU | 3455 | AAUAUCACAGUCCAAGUAA | | [775-793] 3'UTR |
| 250 | 2956 | GUGUUCUCUUACUUGGACU | 3456 | AGUCCAAGUAAGAGAACAC | | [767-785] 3'UTR |
| 251 | 2957 | CUCAACACGGAUAUCAGCA | 3457 | UGCUGAUAUCCGUGUUGAG | | [499-517] ORF |
| 252 | 2958 | UCGACUACAUCUUGGACCU | 3458 | AGGUCCAAGAUGUAGUCGA | | [389-407] ORF |
| 253 | 2959 | AAAGCCUUCAGUCCCGUGA | 3459 | UCACGGGACUGAAGGCUUU | | [187-205] ORF |
| 254 | 2960 | AGCACGUCAUCGACUACAU | 3460 | AUGUAGUCGAUGACGUGCU | | [380-398] ORF |
| 255 | 2961 | AUGUCUAUUUCUGCAUUCA | 3461 | UGAAUGCAGAAAUAGACAU | | [1113-1131] 3'UTR |
| 256 | 2962 | AGAGUUUCUUGUAUAGUG | 3462 | CACUAUACAAGAAAACUCU | Ms | [1088-1106] 3'UTR |
| 257 | 2963 | GAGCGUGAAUACCAGAAGG | 3463 | CCUUCUGGUAUUCACGCUC | | [937-955] 3'UTR |
| 258 | 2964 | CUAAGCAGACUUUGCCUUU | 3464 | AAAGGCAAAGUCUGCUUAG | | [907-925] 3'UTR |
| 259 | 2965 | UUCUGCAGUUGGAAGGUUU | 3465 | AAACCUUCCAACUGCAGAA | | [826-844] 3'UTR |
| 260 | 2966 | ACAACAAAUUCACGGAAUC | 3466 | GAUUCCGUGAAUUUGUUGU | | [635-653] 3'UTR |
| 261 | 2967 | AAUUCCCUUCUGAGUUAAU | 3467 | AUUAACUCAGAAGGGAAAU | | [539-557] ORF |
| 262 | 2968 | CAUCGACUACAUCUUGGAC | 3468 | GUCCAAGAUGUAGUCGAUG | | [387-405] ORF |
| 263 | 2969 | UGCAGCACGUCAUCGACUA | 3469 | UAGUCGAUGACGUGCUGCA | | [377-395] ORF |
| 264 | 2970 | UGACACAAGCCUACUGAAU | 3470 | AUUCAGUAGGCUUGUGUCA | | [1007-1025] 3'UTR |
| 265 | 2971 | UCUUUGCACAACAACAACA | 3471 | UGUUGUUGUUGUGCAAAGA | | [616-634] 3'UTR |
| 266 | 2972 | GUGGCUGAAUAAGCGGUGU | 3472 | ACACCGCUUAUUCAGCCAC | | [581-599] ORF+3'UTR |
| 267 | 2973 | ACGGAUAUCAGCAUCCUGU | 3473 | ACAGGAUGCUGAUAUCCGU | | [505-523] ORF |
| 268 | 2974 | ACUCGCAUCCCACUAUUGU | 3474 | ACAAUAGUGGGAUGCGAGU | | [422-440] ORF |
| 269 | 2975 | UGAGUGAAACCUUGUGAAC | 3475 | GUUCACAAGGUUUCACUCA | | [1060-1078] 3'UTR |
| 270 | 2976 | UCUUUUGGUCAGAAAUUAC | 3476 | GUAAUUUCUGACCAAAAGA | | [983-1001] 3'UTR |
| 271 | 2977 | GGAUCCAGUAUUCAGUCAC | 3477 | GUGACUGAAUACUGGAUCC | | [954-972] 3'UTR |
| 272 | 2978 | GAUCAUCUUCCCAGGGUGU | 3478 | ACACCCUGGGAAGAUGAUC | | [752-770] 3'UTR |

FIGURE 4 Continued

| | | | | | | | |
|---|---|---|---|---|---|---|---|
| 273 | 2979 | CACGGAAUCUUUUAAGUGC | 3479 | GCACUUAAAAGAUUCCGUG | | [645-663] 3'UTR |
| 274 | 2980 | GUUAGGAAAAACAGCCUGU | 3480 | ACAGGCUGUUUUUCCUAAC | Rat,Ms | [211-229] ORF |
| 275 | 2981 | CGGAUAUCAGCAUCCUGUC | 3481 | GACAGGAUGCUGAUAUCCG | | [506-524] ORF |
| 276 | 2982 | CAGAACAAGAAGGUGAGCA | 3482 | UGCUCACCUUCUUGUUCUG | GP,Chn | [346-364] ORF |
| 277 | 2983 | GUAUAGUGGCAGAGAUGUC | 3483 | GACAUCUCUGCCACUAUAC | | [1099-1117] 3'UTR |
| 278 | 2984 | AUGAAGUCUUUUGGUCAGA | 3484 | UCUGACCAAAAGACUUCAU | | [977-995] 3'UTR |
| 279 | 2985 | GCCCAAUCUAAGCAGACUU | 3485 | AAGUCUGCUUAGAUUGGGC | | [900-918] 3'UTR |
| 280 | 2986 | GAGCCUGCUAUACAACAUG | 3486 | CAUGUUGUAUAGCAGGCUC | | [282-300] ORF |
| 281 | 2987 | CCGUUAGGAAAAACAGCCU | 3487 | AGGCUGUUUUUCCUAACGG | Rat,Ms | [209-227] ORF |
| 282 | 2988 | CUCGCAUCCCACUAUUGUC | 3488 | GACAAUAGUGGGAUGCGAG | | [423-441] ORF |
| 283 | 2989 | CCCAGAACAAGAAGGUGAG | 3489 | CUCACCUUCUUGUUCUGGG | GP,Chn | [344-362] ORF |
| 284 | 2990 | ACUCCAAGCUCAAGGAGCU | 3490 | AGCUCCUUGAGCUUGGAGU | | [311-329] ORF |
| 285 | 2991 | UAUUUGAGUGAAACCUUGU | 3491 | ACAAGGUUUCACUCAAAUA | | [1056-1074] 3'UTR |
| 286 | 2992 | CUUUUUGACACAAGCCUAC | 3492 | GUAGGCUUGUGUCAAAAAG | | [1002-1020] 3'UTR |
| 287 | 2993 | AAUGAAGUCUUUUGGUCAG | 3493 | CUGACCAAAAGACUUCAUU | | [976-994] 3'UTR |
| 288 | 2994 | UACAACAUGAACGACUGCU | 3494 | AGCAGUCGUUCAUGUUGUA | Rat,Ms,GP | [292-310] ORF |
| 289 | 2995 | AAUCACAAGGAAUUGCCCA | 3495 | UGGGCAAUUCCUUGUGAUU | Ms | [886-904] 3'UTR |
| 290 | 2996 | AAAUGCCCUUUCUGCAGUU | 3496 | AACUGCAGAAAGGGCAUUU | | [817-835] 3'UTR |
| 291 | 2997 | AGGGUGUUCUCUUACUUGG | 3497 | CCAAGUAAGAGAACACCCU | | [764-782] 3'UTR |
| 292 | 2998 | CUGUGUGGCUGAAUAAGCG | 3498 | CGCUUAUUCAGCCACACAG | | [577-595] ORF+3'UTR |
| 293 | 2999 | AGUUAAUGUCAAAUGACAG | 3499 | CUGUCAUUUGACAUUAACU | | [551-569] ORF |
| 294 | 3000 | CUGAAUUCCUUCUGAGUU | 3500 | AACUCAGAAGGGAAUUCAG | | [536-554] ORF |
| 295 | 3001 | GACUCGCAUCCCACUAUUG | 3501 | CAAUAGUGGGAUGCGAGUC | | [421-439] ORF |
| 296 | 3002 | AGUGGCAGAGAUGUCUAUU | 3502 | AAUAGACAUCUCUGCCACU | | [1103-1121] 3'UTR |
| 297 | 3003 | UGUAUAGUGGCAGAGAUGU | 3503 | ACAUCUCUGCCACUAUACA | | [1098-1116] 3'UTR |
| 298 | 3004 | UCAGUCACUUAAAUGAAGU | 3504 | ACUUCAUUUAAGUGACUGA | | [965-983] 3'UTR |
| 299 | 3005 | UCAGCAUGAAAGCCUUCAG | 3505 | CUGAAGGCUUUCAUGCUGA | | [179-197] 5'UTR+ORF |
| 300 | 3006 | UCAAAUGACAGCAAAGCAC | 3506 | GUGCUUUGCUGUCAUUUGA | Chn | [559-577] ORF |
| 301 | 3007 | UACAUCUUGGACCUGCAGA | 3507 | UCUGCAGGUCCAAGAUGUA | Ms | [394-412] ORF |
| 302 | 3008 | GGUCAGCAUGAAAGCCUUC | 3508 | GAAGGCUUUCAUGCUGACC | | [177-195] 5'UTR+ORF |
| 303 | 3009 | ACGUCAUCGACUACAUCUU | 3509 | AAGAUGUAGUCGAUGACGU | | [383-401] ORF |
| 304 | 3010 | CUUUAUUUCAGAGGACCAG | 3510 | CUGGUCCUCUGAAAAUAAAG | | [1243-1261] 3'UTR |
| 305 | 3011 | AUAGUGGCAGAGAUGUCUA | 3511 | UAGACAUCUCUGCCACUAU | | [1101-1119] 3'UTR |
| 306 | 3012 | UUUGAGUGAAACCUUGUGA | 3512 | UCACAAGGUUUCACUCAAA | | [1058-1076] 3'UTR |
| 307 | 3013 | CUUUUAAAUGCCCUUUCUG | 3513 | CAGAAAGGGCAUUUAAAAG | | [812-830] 3'UTR |
| 308 | 3014 | UGAUCAUCUUCCCAGGGUG | 3514 | CACCCUGGGAAGAUGAUCA | | [751-769] 3'UTR |
| 309 | 3015 | AGGAAAACUAAGAAUGAUC | 3515 | GAUCAUUCUUAGUUUUCCU | | [737-755] 3'UTR |
| 310 | 3016 | ACUGAACCCAAAUAAAUAC | 3516 | GUAUUUAUUUGGGUUCAGU | Ms | [1291-1309] 3'UTR |
| 311 | 3017 | AUUUCAGAGGACCAGUGCU | 3517 | AGCACUGGUCCUCUGAAAU | | [1247-1265] 3'UTR |
| 312 | 3018 | AGCGUGAAUACCAGAAGGA | 3518 | UCCUUCUGGUAUUCACGCU | | [938-956] 3'UTR |
| 313 | 3019 | ACAAGGAAUUGCCCAAUCU | 3519 | AGAUUGGGCAAUUCCUUGU | | [890-908] 3'UTR |
| 314 | 3020 | UUCACAAGGAGGACAAGUU | 3520 | AACUUGUCCUCCUUGUGAA | | [684-702] 3'UTR |
| 315 | 3021 | AUUUCACAAGGAGGACAAG | 3521 | CUUGUCCUCCUUGUGAAAU | | [682-700] 3'UTR |
| 316 | 3022 | UCAACCAUUUCACAAGGAG | 3522 | CUCCUUGUGAAAUGGUUGA | | [676-694] 3'UTR |
| 317 | 3023 | AGCGGUGUUCAUGAUUUCU | 3523 | AGAAAUCAUGAACACCGCU | | [592-610] 3'UTR |
| 318 | 3024 | UGACAGCAAAGCACUGUGU | 3524 | ACACAGUGCUUUGCUGUCA | | [564-582] ORF |
| 319 | 3025 | CGUCAUCGACUACAUCUUG | 3525 | CAAGAUGUAGUCGAUGACG | | [384-402] ORF |
| 320 | 3026 | AAGUGUGUUUAUUGAAUGG | 3526 | CCAUUCAAUAAACACACUU | | [1214-1232] 3'UTR |
| 321 | 3027 | ACGACUGCUACUCCAAGCU | 3527 | AGCUUGGAGUAGCAGUCGU | Rat,Ms,GP,Chn | [302-320] ORF |
| 322 | 3028 | UGGUCAGAAAUUACCUUUU | 3528 | AAAAGGUAAUUUCUGACCA | | [988-1006] 3'UTR |
| 323 | 3029 | ACCAGAAGGAUCCAGUAUU | 3529 | AAUACUGGAUCCUUCUGGU | | [947-965] 3'UTR |
| 324 | 3030 | CUGCUAUACAACAUGAACG | 3530 | CGUUCAUGUUGUAUAGCAG | | [286-304] ORF |
| 325 | 3031 | GGAAUUGCCCAAUCUAAGC | 3531 | GCUUAGAUUGGGCAAUUCC | | [894-912] 3'UTR |
| 326 | 3032 | CUUUCUGCAGUUGGAAGGU | 3532 | ACCUUCCAACUGCAGAAAG | | [824-842] 3'UTR |
| 327 | 3033 | GUGUGGCUGAAUAAGCGGU | 3533 | ACCGCUUAUUCAGCCACAC | | [579-597] ORF+3'UTR |
| 328 | 3034 | UCAGAGGACCAGUGCUUUG | 3534 | CAAAGCACUGGUCCUCUGA | | [1250-1268] 3'UTR |
| 329 | 3035 | UUCAGAGGACCAGUGCUUU | 3535 | AAAGCACUGGUCCUCUGAA | | [1249-1267] 3'UTR |
| 330 | 3036 | AUUGAAUGGUGAUUGCCUG | 3536 | CAGGCAAUCACCAUUCAAU | | [1224-1242] 3'UTR |
| 331 | 3037 | AUGAUGUACUUAUUCAUGC | 3537 | GCAUGAAUAAGUACAUCAU | | [1140-1158] 3'UTR |
| 332 | 3038 | GCAGAGAUGUCUAUUUCUG | 3538 | CAGAAAUAGACAUCUCUGC | | [1107-1125] 3'UTR |
| 333 | 3039 | UUGUAUAGUGGCAGAGAUG | 3539 | CAUCUCUGCCACUAUACAA | | [1097-1115] 3'UTR |
| 334 | 3040 | UUCAGUCACUUAAAUGAAG | 3540 | CUUCAUUUAAGUGACUGAA | | [964-982] 3'UTR |
| 335 | 3041 | GUAUUCAGUCACUUAAAUG | 3541 | CAUUUAAGUGACUGAAUAC | | [961-979] 3'UTR |
| 336 | 3042 | UGAAUACCAGAAGGAUCCA | 3542 | UGGAUCCUUCUGGUAUUCA | | [942-960] 3'UTR |
| 337 | 3043 | GCAGACUUUGCCUUUUUUC | 3543 | GAAAAAAGGCAAAGUCUGC | | [911-929] 3'UTR |
| 338 | 3044 | CAUCUUCCCAGGGUGUUCU | 3544 | AGAACACCCUGGGAAGAUG | | [755-773] 3'UTR |
| 339 | 3045 | UUCACGGAAUCUUUUAAGU | 3545 | ACUUAAAAGAUUCCGUGAA | | [643-661] 3'UTR |
| 340 | 3046 | UUCUGAAUUCCCUUCUGAG | 3546 | CUCAGAAGGGAAUUCAGAA | | [534-552] ORF |

FIGURE 4 Continued

| # | ID | Seq1 | ID2 | Seq2 | Species | Location |
|---|---|---|---|---|---|---|
| 341 | 3047 | UGGACUCGCAUCCCACUAU | 3547 | AUAGUGGGAUGCGAGUCCA | Ms | [419-437] ORF |
| 342 | 3048 | CUGCUACUCCAAGCUCAAG | 3548 | CUUGAGCUUGGAGUAGCAG | Rat,Ms | [306-324] ORF |
| 343 | 3049 | GAAUUGCCCAAUCUAAGCA | 3549 | UGCUUAGAUUGGGCAAUUC | | [895-913] 3'UTR |
| 344 | 3050 | UGCAGUUGGAAGGUUUUCU | 3550 | AGAAAACCUUCCAACUGCA | | [829-847] 3'UTR |
| 345 | 3051 | UUUAAAUGCCCUUUCUGCA | 3551 | UGCAGAAAGGGCAUUUAAA | | [814-832] 3'UTR |
| 346 | 3052 | AUAAGCGGUGUUCAUGAUU | 3552 | AAUCAUGAACACCGCUUAU | | [589-607] 3'UTR |
| 347 | 3053 | GUCAGCAUGAAAGCCUUCA | 3553 | UGAAGGCUUUCAUGCUGAC | | [178-196] 5'UTR+ORF |
| 348 | 3054 | GAGGUCCGUUAGGAAAAAC | 3554 | GUUUUCCUAACGGACCUC | Rat,Ms | [204-222] ORF |
| 349 | 3055 | GCUAUGUUAUAACUGAACC | 3555 | GGUUCAGUUAUAACAUAGC | Ms | [1280-1298] 3'UTR |
| 350 | 3056 | UUCUGCAUUCAAAAGUGUA | 3556 | UACACUUUUGAAUGCAGAA | | [1121-1139] 3'UTR |
| 351 | 3057 | CAGAGAUGUCUAUUUCUGC | 3557 | GCAGAAAUAGACAUCUCUG | | [1108-1126] 3'UTR |
| 352 | 3058 | UAUAGUGGCAGAGAUGUCU | 3558 | AGACAUCUCUGCCACUAUA | | [1100-1118] 3'UTR |
| 353 | 3059 | UUAUAUACUAUUCCCACCA | 3559 | UGGUGGGAAUAGUAUAUAA | Ms | [848-866] 3'UTR |
| 354 | 3060 | AAGAAUGAUCAUCUUCCCA | 3560 | UGGGAAGAUGAUCAUUCUU | | [748-764] 3'UTR |
| 355 | 3061 | AGUGCUGAACUUAUUUUUC | 3561 | GAAAAAUAAGUUCAGCACU | | [659-677] 3'UTR |
| 356 | 3062 | AUGUCAAUGACAGCAAAG | 3562 | CUUUGCUGUCAUUUGACAU | | [556-574] ORF |
| 357 | 3063 | GAUGUCUAUUUCUGCAUUC | 3563 | GAAUGCAGAAAUAGACAUC | | [1112-1130] 3'UTR |
| 358 | 3064 | UUUGACACAAGCCUACUGA | 3564 | UCAGUAGGCUUGUGUCAAA | | [1005-1023] 3'UTR |
| 359 | 3065 | CUUAAAAUGAAGUCUUUUGG | 3565 | CCAAAAGACUUCAUUUUAAG | | [972-990] 3'UTR |
| 360 | 3066 | GUCACUUAAAUGAAGUCUU | 3566 | AAGACUUCAUUUAAGUGAC | | [968-986] 3'UTR |
| 361 | 3067 | CAAUCUAAGCAGACUUUGC | 3567 | GCAAAGUCUGCUUAGAUUG | | [903-921] 3'UTR |
| 362 | 3068 | CCAAUCUAAGCAGACUUUG | 3568 | CAAAGUCUGCUUAGAUUGG | | [902-920] 3'UTR |
| 363 | 3069 | AAACGUUAAAAUCACAAGG | 3569 | CCUUGUGAUUUUAACGUUU | | [877-895] 3'UTR |
| 364 | 3070 | AUAUACUAUUCCCACCAUG | 3570 | CAUGGUGGGAAUAGUAUAU | Ms | [850-868] 3'UTR |
| 365 | 3071 | AUGAGCCUGCUAUACAACA | 3571 | UGUUGUAUAGCAGGCUCAU | | [280-298] ORF |
| 366 | 3072 | UGAAUAAGCGGUGUUCAUG | 3572 | CAUGAACACCGCUUAUUCA | | [586-604] ORF+3'UTR |
| 367 | 3073 | UGGCAGAGAUGUCUAUUUC | 3573 | GAAAUAGACAUCUCUGCCA | | [1105-1123] 3'UTR |
| 368 | 3074 | GACACAAGCCUACUGAAUG | 3574 | CAUUCAGUAGGCUUGUGUC | | [1008-1026] 3'UTR |
| 369 | 3075 | CAGUCACUUAAAUGAAGUC | 3575 | GACUUCAUUUAAGUGACUG | | [966-984] 3'UTR |
| 370 | 3076 | AAGCAGACUUUGCCUUUUU | 3576 | AAAAAGGCAAAGUCUGCUU | | [909-927] 3'UTR |
| 371 | 3077 | UGGCUGAAUAAGCGGUGUU | 3577 | AACACCGCUUAUUCAGCCA | | [582-600] ORF+3'UTR |
| 372 | 3078 | UCUGAAUUCCCUUCUGAGU | 3578 | ACUCAGAAGGGAAUUCAGA | | [535-553] ORF |
| 373 | 3079 | UCCUUGCAGGCUUCUGAAU | 3579 | AUUCAGAAGCCUGCAAGGA | | [523-541] ORF |
| 374 | 3080 | CGACUACAUCUUGGACCUG | 3580 | CAGGUCCAAGAUGUAGUCG | | [390-408] ORF |
| 375 | 3081 | CAAGUGGAAAUCCAUCUUG | 3581 | CUGCAGGAUUUCCAUCUUG | Rat,Ms | [363-381] ORF |
| 376 | 3082 | CAUGAAAGCCUUCAGUCCC | 3582 | GGGACUGAAGGCUUUCAUG | | [183-201] 5'UTR+ORF |
| 377 | 3083 | CUAUGUUAUAACUGAACCC | 3583 | GGGUUCAGUUAUAACAUAG | Ms | [1281-1299] 3'UTR |
| 378 | 3084 | CUAUUUCUGCAUUCAAAAG | 3584 | CUUUUGAAUGCAGAAAUAG | | [1117-1135] 3'UTR |
| 379 | 3085 | UCACAAGGCAAUUCCCAAU | 3585 | AUUGGGCAAUUCCUUGUGA | Ms | [888-906] 3'UTR |
| 380 | 3086 | GACUUUUAAAUGCCCUUUC | 3586 | GAAAGGGCAUUUAAAAGUC | | [810-828] 3'UTR |
| 381 | 3087 | UUCAACCAUUUCACAAGGA | 3587 | UCCUUGUGAAAUGGUUGAA | | [675-693] 3'UTR |
| 382 | 3088 | CAACAAAUUCACGGAAUCU | 3588 | AGAUUCCGUGAAUUUGUUG | | [636-654] 3'UTR |
| 383 | 3089 | CGUUAGGAAAAACAGCCUG | 3589 | CAGGCUGUUUUUCCUAACG | Rat,Ms | [210-228] ORF |
| 384 | 3090 | AGCAAAGCACUGUGUGGCU | 3590 | AGCCACACAGUGCUUUGCU | | [568-586] ORF |
| 385 | 3091 | GUCCGUUAGGAAAAACAGC | 3591 | GCUGUUUUUCCUAACGGAC | Rat,Ms | [207-225] ORF |
| 386 | 3092 | CUACAUCUUGGACCUGCAG | 3592 | CUGCAGGUCCAAGAUGUAG | | [393-411] ORF |
| 387 | 3093 | UAUGUUAUAACUGAACCCA | 3593 | UGGGUUCAGUUAUAACAUA | Ms | [1282-1300] 3'UTR |
| 388 | 3094 | UUUCAGAGGACCAGUGCUU | 3594 | AAGCACUGGUCCUCUGAAA | | [1248-1266] 3'UTR |
| 389 | 3095 | CAAAAGUGUAAUGAUGUAC | 3595 | GUACAUCAUUUACACUUUUG | | [1130-1148] 3'UTR |
| 390 | 3096 | GUGAACUCUUUAAUUAGAG | 3596 | CUCUAAUUAAAGAGUUCAC | | [1073-1091] 3'UTR |
| 391 | 3097 | GUGAAACCUUGUGAACUCU | 3597 | AGAGUUCACAAGGUUUCAC | | [1063-1081] 3'UTR |
| 392 | 3098 | UUUGGUCAGAAAUUACCUU | 3598 | AAGGUAAUUUCUGACCAAA | | [986-1004] 3'UTR |
| 393 | 3099 | UGCCUUUUUUCAAGGUGG | 3599 | CCACCUUUGAAAAAAGGCA | | [919-937] 3'UTR |
| 394 | 3100 | AAGACUUUUAAAUGCCCUU | 3600 | AAGGGCAUUUAAAAGUCUU | | [808-826] 3'UTR |
| 395 | 3101 | ACUUGGACUGUGAUAUUCG | 3601 | CGAAUAUCACAGUCCAAGU | | [777-795] 3'UTR |
| 396 | 3102 | AAAUGACAGCAAAGCACUG | 3602 | CAGUGCUUUGCUGUCAUUU | | [561-579] ORF |
| 397 | 3103 | UUUAUUUCAGAGGACCAGU | 3603 | ACUGGUCCUCUGAAAUAAA | | [1244-1262] 3'UTR |
| 398 | 3104 | GUACUUAUUCAUGCUAAAC | 3604 | GUUUAGCAUGAAUAAGUAC | | [1145-1163] 3'UTR |
| 399 | 3105 | AACGACUGCUACUCCAAGC | 3605 | GCUUGGAGUAGCAGUCGUU | Rat,Ms,GP,Chn | [301-319] ORF |
| 400 | 3106 | UUUUCAACCAUUUCACAAG | 3606 | CUUGUGAAAUGGUUGAAAA | | [673-691] 3'UTR |
| 401 | 3107 | AUCUUUUAAGUGCUGAACU | 3607 | AGUUCAGCACUUAAAAGAU | | [651-669] 3'UTR |
| 402 | 3108 | UGAGUUAAUGUCAAAUGAC | 3608 | GUCAUUUGACAUUAACUCA | | [549-567] ORF |
| 403 | 3109 | UUCCCUUCUGAGUUAAUGU | 3609 | ACAUUAACUCAGAAGGGAA | | [541-559] ORF |
| 404 | 3110 | ACACGGAUAUCAGCAUCCU | 3610 | AGGAUGCUGAUAUCCGUGU | | [503-521] ORF |
| 405 | 3111 | CGCAUCCCACUAUUGCAG | 3611 | CUGCAAUAGUGGGAUGCG | | [425-443] ORF |
| 406 | 3112 | GAUGGAAAUCCUGCAGCAC | 3612 | GUGCUGCAGGAUUUCCAUC | Rat,Ms | [366-384] ORF |
| 407 | 3113 | CCAGAACAAGAAGGUGAGC | 3613 | GCUCACCUUCUUGUUCUGG | GP,Chn | [345-363] ORF |
| 408 | 3114 | UAUUGAAUGGUGAUUGCCU | 3614 | AGGCAAUCACCAUUCAAUA | | [1223-1241] 3'UTR |

FIGURE 4 Continued

| # | ID | Sequence 1 | ID2 | Sequence 2 | Species | Location |
|---|---|---|---|---|---|---|
| 409 | 3115 | AUUUCUGCAUUCAAAAGUG | 3615 | CACUUUUGAAUGCAGAAAU | | [1119-1137] 3'UTR |
| 410 | 3116 | AAUACCAGAAGGAUCCAGU | 3616 | ACUGGAUCCUUCUGGUAUU | | [944-962] 3'UTR |
| 411 | 3117 | UGCCCAAUCUAAGCAGACU | 3617 | AGUCUGCUUAGAUUGGGCA | | [899-917] 3'UTR |
| 412 | 3118 | GGCUGAAUAAGCGGUGUUC | 3618 | GAACACCGCUUAUUCAGCC | | [583-601] ORF+3'UTR |
| 413 | 3119 | GUCAUCGACUACAUCUUGG | 3619 | CCAAGAUGUAGUCGAUGAC | | [385-403] ORF |
| 414 | 3120 | CACGUCAUCGACUACAUCU | 3620 | AGAUGUAGUCGAUGACGUG | | [382-400] ORF |
| 415 | 3121 | AAUCCUGCAGCACGUCAUC | 3621 | GAUGACGUGCUGCAGGAUU | Rat,Ms | [372-390] ORF |
| 416 | 3122 | AGUGAAACCUUGUGAACUC | 3622 | GAGUUCACAAGGUUUCACU | | [1062-1080] 3'UTR |
| 417 | 3123 | UAAGCAGACUUUUGCCUUUU | 3623 | AAAAGGCAAAGUCUGCUUA | Ms | [908-926] 3'UTR |
| 418 | 3124 | UUGGACUGUGAUAUUCGUU | 3624 | AACGAAUAUCACAGUCCAA | | [779-797] 3'UTR |
| 419 | 3125 | GCUGAACUUAUUUUUCAAC | 3625 | GUUGAAAAAUAAGUUCAGC | | [662-680] 3'UTR |
| 420 | 3126 | ACCACCCUCAACACGGAUA | 3626 | UAUCCGUGUUGAGGGUGGU | | [493-511] ORF |
| 421 | 3127 | UGAAACCUUGUGAACUCUU | 3627 | AAGAGUUCACAAGGUUUCA | | [1064-1082] 3'UTR |
| 422 | 3128 | AAGGAUCCAGUAUUCAGUC | 3628 | GACUGAAUACUGGAUCCUU | | [952-970] 3'UTR |
| 423 | 3129 | AAAUCAAGGAAUUGCCC | 3629 | GGGCAAUUCCUUGUGAUUU | Ms | [885-903] 3'UTR |
| 424 | 3130 | CUUUUAUUCUUUGCACAAC | 3630 | GUUGUGCAAAGAAUAAAAG | | [609-627] 3'UTR |
| 425 | 3131 | AAGCACGUGUGGCUGAAU | 3631 | AUUCAGCCACACAGUGCUU | | [572-590] ORF+3'UTR |
| 426 | 3132 | AUCCUGCCUUGCAGGCUU | 3632 | AAGCCUGCAAGGACAGGAU | | [517-535] ORF |
| 427 | 3133 | CAACACGGAUAUCAGCAUC | 3633 | GAUGCUGAUAUCCGUGUUG | | [501-519] ORF |
| 428 | 3134 | CAGCACGUCAUCGACUACA | 3634 | UGUAGUCGAUGACGUGCUG | | [379-397] ORF |
| 429 | 3135 | UGAAAGCCUUCAGUCCCGU | 3635 | ACGGGACUGAAGGCUUUCA | | [185-203] ORF |
| 430 | 3136 | UGAUUGCCUGCUUUAUUUC | 3636 | GAAAUAAAGCAGGCAAUCA | | [1233-1251] 3'UTR |
| 431 | 3137 | UGCAUUCAAAAGUGUAAUG | 3637 | CAUUACACUUUUGAAUGCA | | [1124-1142] 3'UTR |
| 432 | 3138 | UACCAGAAGGAUCCAGUAU | 3638 | AUACUGGAUCCUUCUGGUA | | [946-964] 3'UTR |
| 433 | 3139 | UAAAUGCCCUUUCUGCAGU | 3639 | ACUGCAGAAAGGGCAUUUA | | [816-834] 3'UTR |
| 434 | 3140 | CUAAGAAUGAUCAUCUUCC | 3640 | GGAAGAUGAUCAUUCUUAG | | [744-762] 3'UTR |
| 435 | 3141 | GCAUCCCACUAUUGUCAGC | 3641 | GCUGACAAUAGUGGGAUGC | | [426-444] ORF |
| 436 | 3142 | AAGAAGGUGAGCAAGAUGG | 3642 | CCAUCUUGCUCACCUUCUU | GP,Chn | [352-370] ORF |
| 437 | 3143 | AUUUGAGUGAAACCUUGUG | 3643 | CACAAGGUUUCACUCAAAU | | [1057-1075] 3'UTR |
| 438 | 3144 | ACACAAGCCUACUGAAUGC | 3644 | GCAUUCAGUAGGCUUGUGU | | [1009-1027] 3'UTR |
| 439 | 3145 | CUGCAGUUGGAAGGUUUUC | 3645 | GAAAACCUUCCAACUGCAG | | [828-846] 3'UTR |
| 440 | 3146 | ACAGCAAAGCACUGUGUGG | 3646 | CCACACAGUGCUUUGCUGU | | [566-584] ORF |
| 441 | 3147 | GACAGCAAAGCACUGUGUG | 3647 | CACACAGUGCUUUGCUGUC | | [565-583] ORF |
| 442 | 3148 | GGCUUCUGAAUUCCCUUCU | 3648 | AGAAGGGAAUUCAGAAGCC | | [531-549] ORF |
| 443 | 3149 | UAUUGUCAGCCUGCAUCAC | 3649 | GUGAUGCAGGCUGACAAUA | | [435-453] ORF |
| 444 | 3150 | AUCCCACUAUUGUCAGCCU | 3650 | AGGCUGACAAUAGUGGGAU | | [428-446] ORF |
| 445 | 3151 | UUUAUUGAAUGGUGAUUGC | 3651 | GCAAUCACCAUUCAAUAAA | | [1221-1239] 3'UTR |
| 446 | 3152 | AAGCCUACUGAAUGCUGUG | 3652 | CACAGCAUUCAGUAGGCUU | | [1013-1031] 3'UTR |
| 447 | 3153 | UUUUGGUCAGAAAUUACCU | 3653 | AGGUAAUUUCUGACCAAAA | | [985-1003] 3'UTR |
| 448 | 3154 | CCUUUUUUCAAAGGUGGAG | 3654 | CUCCACCUUUGAAAAAAGG | | [921-939] 3'UTR |
| 449 | 3155 | ACUUUGCCUUUUUUCAAAG | 3655 | CUUUGAAAAAAGGCAAAGU | | [915-933] 3'UTR |
| 450 | 3156 | UCCCAGGGUGUUCUCUUAC | 3656 | GUAAGAGAACACCCUGGGA | | [760-778] 3'UTR |
| 451 | 3157 | UCAUCUUCCCAGGGUGUUC | 3657 | GAACACCCUGGGAAGAUGA | | [754-772] 3'UTR |
| 452 | 3158 | GAAAAACAGCCUGUCGGAC | 3658 | GUCCGACAGGCUGUUUUUC | Rat,Ms,GP | [216-234] ORF |
| 453 | 3159 | AUUCACGGAAUCUUUUAAG | 3659 | CUUAAAAGAUUCCGUGAAU | | [642-660] 3'UTR |
| 454 | 3160 | UGUGGCUGAAUAAGCGGUG | 3660 | CACCGCUUAUUCAGCCACA | | [580-598] ORF+3'UTR |
| 455 | 3161 | GUUAAUGUCAAAUGACAGC | 3661 | GCUGUCAUUUGACAUUAAC | | [552-570] ORF |
| 456 | 3162 | GAUAUCAGCAUCCUGUCCU | 3662 | AGGACAGGAUGCUGAUAUC | | [508-526] ORF |
| 457 | 3163 | AGUUUUCUUGUAUAGUGGC | 3663 | GCCACUAUACAAGAAAACU | Ms | [1090-1108] 3'UTR |
| 458 | 3164 | AAAGACUUUUAAAUGCCCU | 3664 | AGGGCAUUUAAAAGUCUUU | | [807-825] 3'UTR |
| 459 | 3165 | UAAGAAUGAUCAUCUUCCC | 3665 | GGGAAGAUGAUCAUUCUUA | | [745-763] 3'UTR |
| 460 | 3166 | ACCAUUUCACAAGGAGGAC | 3666 | GUCCUCCUUGUGAAAUGGU | | [679-697] 3'UTR |
| 461 | 3167 | UGUGUGGCUGAAUAAGCGG | 3667 | CCGCUUAUUCAGCCACACA | | [578-596] ORF+3'UTR |
| 462 | 3168 | GGUGAGCAAGAUGGAAAUC | 3668 | GAUUUCCAUCUUGCUCACC | | [357-375] ORF |
| 463 | 3169 | GUUUAUUGAAUGGUGAUUG | 3669 | CAAUCACCAUUCAAUAAAC | | [1220-1238] 3'UTR |
| 464 | 3170 | UGUUCUCUUACUUAGGACUG | 3670 | CAGUCCAAGUAAGAGAACA | | [768-786] 3'UTR |
| 465 | 3171 | GGAUAUCAGCAUCCUGUCC | 3671 | GGACAGGAUGCUGAUAUCC | | [507-525] ORF |
| 466 | 3172 | ACUAUUGUCAGCCUGCAUC | 3672 | GAUGCAGGCUGACAAUAGU | | [433-451] ORF |
| 467 | 3173 | UGCUAUGUUAUAACUGAAC | 3673 | GUUCAGUUAUAACAUAGCA | Ms | [1279-1297] 3'UTR |
| 468 | 3174 | AGUGUGUUUAUUGAAUGGU | 3674 | ACCAUUCAAUAAACACACU | | [1215-1233] 3'UTR |
| 469 | 3175 | UUGCCUUUUUUCAAAGGUG | 3675 | CACCUUUGAAAAAAGGCAA | | [918-936] 3'UTR |
| 470 | 3176 | CCUUUCUGCAGUUGGAAGG | 3676 | CCUUCCAACUGCAGAAAGG | | [823-841] 3'UTR |
| 471 | 3177 | UUUCACAAGGAGGACAAGU | 3677 | ACUUGUCCUCCUUGUGAAA | | [683-701] 3'UTR |
| 472 | 3178 | UUUCAACCAUUUCACAAGG | 3678 | CCUUGUGAAAUGGUUGAAA | | [674-692] 3'UTR |
| 473 | 3179 | AGGAAAAACAGCCUGUCGG | 3679 | CCGACAGGCUGUUUUUCCU | Rat,Ms | [214-232] ORF |
| 474 | 3180 | GACUACAUCUUGGACCUGC | 3680 | GCAGGUCCAAGAUGUAGUC | | [391-409] ORF |
| 475 | 3181 | UGCUUUAUUUCAGAGGACC | 3681 | GGUCCUCUGAAAUAAAGCA | | [1241-1259] 3'UTR |
| 476 | 3182 | UAUCUAUUUGAGUGAAACC | 3682 | GGUUUCACUCAAAUAGAUA | | [1052-1070] 3'UTR |

FIGURE 4 Continued

| | | | | | | | |
|---|---|---|---|---|---|---|---|
| 477 | 3183 | ACCUUUUGACACAAGCCU | 3683 | AGGCUUGUGUCAAAAAGGU | | | [1000-1018] 3'UTR |
| 478 | 3184 | UUACCUUUUGACACAAGC | 3684 | GCUUGUGUCAAAAAGGUAA | | | [998-1016] 3'UTR |
| 479 | 3185 | UAAAUGAAGUCUUUUGGUC | 3685 | GACCAAAAGACUUCAUUUA | | | [974-992] 3'UTR |
| 480 | 3186 | AUCUAAGCAGACUUUUGCCU | 3686 | AGGCAAAGUCUGCUUAGAU | | | [905-923] 3'UTR |
| 481 | 3187 | GUUCUCUUACUUGGACUGU | 3687 | ACAGUCCAAGUAAGAGAAC | | | [769-787] 3'UTR |
| 482 | 3188 | AACAAAUUCACGGAAUCUU | 3688 | AAGAUUCCGUGAAUUUGUU | | | [637-655] 3'UTR |
| 483 | 3189 | UUAUUUCAGAGGACCAGUG | 3689 | CACUGGUCCUCUGAAAUAA | | | [1245-1263] 3'UTR |
| 484 | 3190 | UUUCUGCAUUCAAAAGUGU | 3690 | ACACUUUUGAAUGCAGAAA | | | [1120-1138] 3'UTR |
| 485 | 3191 | AGACUUUUAAAUGCCCUUU | 3691 | AAAGGGCAUUUAAAAGUCU | | | [809-827] 3'UTR |
| 486 | 3192 | UUCUCUUACUUGGACUGUG | 3692 | CACAGUCCAAGUAAGAGAA | | | [770-788] 3'UTR |
| 487 | 3193 | UCUUCCCAGGGUGUUCUCU | 3693 | AGAGAACACCCUGGGAAGA | | | [757-775] 3'UTR |
| 488 | 3194 | AGAAUGAUCAUCUUCCCAG | 3694 | CUGGGAAGAUGAUCAUUCU | | | [747-765] 3'UTR |
| 489 | 3195 | AAUCUUUUAAGUGCUGAAC | 3695 | GUUCAGCACUUAAAAGAUU | | | [650-668] 3'UTR |
| 490 | 3196 | AUGGAAAUCCUGCAGCACG | 3696 | CGUGCUGCAGGAUUUCCAU | Rat,Ms | | [367-385] ORF |
| 491 | 3197 | UUUUUGCACAAGCCUACU | 3697 | AGUAGGCUUGUGUCAAAAA | | | [1003-1021] 3'UTR |
| 492 | 3198 | UUGGUCAGAAAUUUACCUUU | 3698 | AAAGGUAAAUUUCUGACCAA | | | [987-1005] 3'UTR |
| 493 | 3199 | GAAUACCAGAAGGAUCCAG | 3699 | CUGGAUCCUUCUGGUAUUC | | | [943-961] 3'UTR |
| 494 | 3200 | UUGCACAACAACAACAACA | 3700 | UGUUGUUGUUGUUGUGCAA | | | [619-637] 3'UTR |
| 495 | 3201 | UUCUUUGCACAACAACAAC | 3701 | GUUGUUGUUGUGCAAAGAA | | | [615-633] 3'UTR |
| 496 | 3202 | UUAAUGUCAAAUGACAGCA | 3702 | UGCUGUCAUUUGACAUUAA | | | [553-571] ORF |
| 497 | 3203 | CACCCUCAACACGGAUAUC | 3703 | GAUAUCCGUGUUGAGGGUG | | | [495-513] ORF |
| 498 | 3204 | CUACUCCAAGCUCAAGGAG | 3704 | CUCCUUGAGCUUGGAGUAG | | | [309-327] ORF |
| 499 | 3205 | UUUCUGCAGUUGGAAGGUU | 3705 | AACCUUCCAACUGCAGAAA | | | [825-843] 3'UTR |
| 500 | 3206 | UAGUUGUAAACUUAACCCU | 3706 | AGGGUUAAGUUUACAACUA | Ms | | [1178-1196] 3'UTR |

Table A5 ID3 - inhibitor of DNA binding 3

| No. | SEQ ID NO. | Sense siRNA | SEQ ID NO. | AntiSense siRNA | Other Sp | Human-156119620 ORF:406-765 |
|---|---|---|---|---|---|---|
| 1 | 3707 | GACUUCUUUUGGUUUUCUU | 4064 | AAGAAAACCAAAAGAAGUC | | [353-371] 5'UTR |
| 2 | 3708 | GGGCCAUUUUGAAUAAAGA | 4065 | UCUUUAUUCAAAAUGGCCC | Chp | [261-279] 5'UTR |
| 3 | 3709 | GGAGGAAGCCUGUUUGCAA | 4066 | UUGCAAACAGGCUUCCUCC | Chp | [194-212] 5'UTR |
| 4 | 3710 | GGACUUCUUUUGGUUUUCU | 4067 | AGAAAACCAAAAGAAGUCC | | [352-370] 5'UTR |
| 5 | 3711 | AGCAAAUUCUGGAAGUUAA | 4068 | UUAACUUCCAGAAUUUGCU | Chp | [61-79] 5'UTR |
| 6 | 3712 | GCAAAUUCUGGAAGUUAAU | 4069 | AUUAACUUCCAGAAUUUGC | Chp | [62-80] 5'UTR |
| 7 | 3713 | CCCACUUGACUUCACCAAA | 4070 | UUUGGUGAAGUCAAGUGGG | Chp | [882-900] 3'UTR |
| 8 | 3714 | CUUUUGGUUUUCUUUCUCU | 4071 | AGAGAAAGAAAACCAAAAG | | [358-376] 5'UTR |
| 9 | 3715 | GCUUGCUGGACGACAUGAA | 4072 | UUCAUGUCGUCCAGCAAGC | Chp | [521-539] ORF |
| 10 | 3716 | AAGCCUGUUUGCAAUUUAA | 4073 | UUAAAUUGCAAACAGGCUU | Chp | [199-217] 5'UTR |
| 11 | 3717 | GGAAGUUAAUGGUUUUGAG | 4074 | CUCAAAACCAUUAACUUCC | Chp | [71-89] 5'UTR |
| 12 | 3718 | GGAAAAAGCAAAUUCUGGA | 4075 | UCCAGAAUUUGCUUUUUCC | Chp | [55-73] 5'UTR |
| 13 | 3719 | GAGGAAGCCUGUUUGCAAU | 4076 | AUUGCAAACAGGCUUCCUC | Chp | [195-213] 5'UTR |
| 14 | 3720 | CCCUGAUUUAUGAACUCUA | 4077 | UAGAGUUCAUAAAUCAGGG | Chp | [1136-1154] 3'UTR |
| 15 | 3721 | AGGAGCGAAGGACUGUGAA | 4078 | UUCACAGUCCUUCGCUCCU | Chp | [930-948] 3'UTR |
| 16 | 3722 | CGGAACUUGUCAUCUCCAA | 4079 | UUGGAGAUGACAAGUUCCG | Chp | [722-740] ORF |
| 17 | 3723 | CGGGACUUCUUUUGGUUUU | 4080 | AAAACCAAAAGAAGUCCCG | | [350-368] 5'UTR |
| 18 | 3724 | GCGGGCCAUUUUGAAUAAA | 4081 | UUUAUUCAAAAUGGCCCGC | Chp | [259-277] 5'UTR |
| 19 | 3725 | CAGGGAAGCUCAAAGAUCU | 4082 | AGAUCUUUGAGCUUCCCUG | | [24-42] 5'UTR |
| 20 | 3726 | GAAAAAGCAAAUUCUGGAA | 4083 | UUCCAGAAUUUGCUUUUUC | Chp | [56-74] 5'UTR |
| 21 | 3727 | UGAGCUUGCUGGACGACAU | 4084 | AUGUCGUCCAGCAAGCUCA | Chp | [518-536] ORF |
| 22 | 3728 | GGCGGGCCAUUUUGAAUAA | 4085 | UUAUUCAAAAUGGCCCGCC | Chp | [258-276] 5'UTR |
| 23 | 3729 | AAUUUAAGCGGGCUGUGAA | 4086 | UUCACAGCCCGCUUAAAUU | Chp | [211-229] 5'UTR |
| 24 | 3730 | GCGGGACUUCUUUUGGUUU | 4087 | AAACCAAAAGAAGUCCCGC | | [349-367] 5'UTR |
| 25 | 3731 | AGGUGACUUUCUGUAACAA | 4088 | UUGUUACAGAAAGUCACCU | Chp | [1192-1210] 3'UTR |
| 26 | 3732 | GAAGCCUGUUUGCAAUUUA | 4089 | UAAAUUGCAAACAGGCUUC | Chp | [198-216] 5'UTR |
| 27 | 3733 | GGUGACUUUCUGUAACAAU | 4090 | AUUGUUACAGAAAGUCACC | | [1193-1211] 3'UTR |
| 28 | 3734 | UGAACUUGUGGCCUGAAGA | 4091 | UCUUCAGGCCACAAGUUCA | Chp | [945-963] 3'UTR |
| 29 | 3735 | CUGUGAACUUGUGGCCUGA | 4092 | UCAGGCCACAAGUUCACAG | Chp | [942-960] 3'UTR |
| 30 | 3736 | CCAGGAAAAAGCAAAUUCU | 4093 | AGAAUUUGCUUUUUCCUGG | Chp | [52-70] 5'UTR |
| 31 | 3737 | CUUCCAGGCAGGCUCUAUA | 4094 | UAUAGAGCCUGCCUGGAAG | | [287-305] 5'UTR |
| 32 | 3738 | CUUCUUUUGGUUUUCUUUC | 4095 | GAAAGAAAACCAAAAGAAG | | [355-373] 5'UTR |
| 33 | 3739 | AGUUAAUGGUUUUGAGUGA | 4096 | UCACUCAAAACCAUUAACU | Chp | [74-92] 5'UTR |
| 34 | 3740 | AGCGGGACUUCUUUUGGUU | 4097 | AACCAAAAGAAGUCCCGCU | | [348-366] 5'UTR |
| 35 | 3741 | GCUGCCAGGAAAAAGCAAA | 4098 | UUUGCUUUUUCCUGGCAGC | Chp | [48-66] 5'UTR |
| 36 | 3742 | CCAAAUCCCUUCCUGGAGA | 4099 | UCUCCAGGAAGGGAUUUGG | | [896-914] 3'UTR |

FIGURE 4 Continued

| | | | | | | |
|---|---|---|---|---|---|---|
| 37 | 3743 | GCCAGGUGGAAAUCCUACA | 4100 | UGUAGGAUUUCCACCUGGC | Chp | [599-617] ORF |
| 38 | 3744 | CAAUUUAAGCGGGCUGUGA | 4101 | UCACAGCCCGCUUAAAUUG | Chp | [210-228] 5'UTR |
| 39 | 3745 | GAGGCGGGCCAUUUUGAAU | 4102 | AUUCAAAAUGGCCCGCCUC | Chp | [256-274] 5'UTR |
| 40 | 3746 | CUGUAACAAUGCGAUGUAU | 4103 | AUACAUCGCAUUGUUACAG | Chp | [1202-1220] 3'UTR |
| 41 | 3747 | CUGUUGCCCUGAUUUAUGA | 4104 | UCAUAAAUCAGGGCAACAG | Chp | [1130-1148] 3'UTR |
| 42 | 3748 | AGCUUAGCCAGGUGGAAAU | 4105 | AUUUCCACCUGGCUAAGCU | Rat,Ms,GP,Chn,Chp | [593-611] ORF |
| 43 | 3749 | GCGCUUCCUCAUUCUUUGA | 4106 | UCAAAGAAUGAGGAAGCGC | Chp | [139-157] 5'UTR |
| 44 | 3750 | CGAUUUUUAAACACUUGUG | 4107 | CACAAGUGUUUAAAAAUCG | Chp | [1260-1278] 3'UTR |
| 45 | 3751 | GUUCUGUUGCCCUGAUUUA | 4108 | UAAAUCAGGGCAACAGAAC | Chp | [1127-1145] 3'UTR |
| 46 | 3752 | GGUUCUGUUGCCCUGAUUU | 4109 | AAAUCAGGGCAACAGAACC | Chp | [1126-1144] 3'UTR |
| 47 | 3753 | UCUUUUGGUUUUCUUUCUC | 4110 | GAGAAAGAAAACCAAAAGA | | [357-375] 5'UTR |
| 48 | 3754 | CUUUUUUACAGGAAGGUGA | 4111 | UCACCUUCCUGUAAAAAAG | Ms,Chp | [1179-1197] 3'UTR |
| 49 | 3755 | GCCCACUUGACUUCACCAA | 4112 | UUGGUGAAGUCAAGUGGGC | Chp | [881-899] 3'UTR |
| 50 | 3756 | ACGACAUGAACCACUGCUA | 4113 | UAGCAGUGGUUCAUGUCGU | Rat,Ms,GP,Chn,Chp | [530-548] ORF |
| 51 | 3757 | CCAGGCAGGCUCUAUAAGU | 4114 | ACUUAUAGAGCCUGCCUGG | | [290-308] 5'UTR |
| 52 | 3758 | CGGGCCAUUUUGAAUAAAG | 4115 | CUUUAUUCAAAAUGGCCCG | Chp | [260-278] 5'UTR |
| 53 | 3759 | GGUAUCAGCGCUUCCUCAU | 4116 | AUGAGGAAGCGCUGAUACC | | [132-150] 5'UTR |
| 54 | 3760 | AGGCAGGCUCUAUAAGUGA | 4117 | UCACUUAUAGAGCCUGCCU | | [292-310] 5'UTR |
| 55 | 3761 | CUUGGAGAAAGGUUCUGUU | 4118 | AACAGAACCUUUCUCCAAG | Chp | [1116-1134] 3'UTR |
| 56 | 3762 | CGACAUGAACCACUGCUAC | 4119 | GUAGCAGUGGUUCAUGUCG | Rat,Ms,GP,Chn,Chp | [531-549] ORF |
| 57 | 3763 | UCUGGAAGUUAAUGGUUUU | 4120 | AAAACCAUUAACUUCCAGA | Chp | [68-86] 5'UTR |
| 58 | 3764 | CCUGGAGACUAAACCUGGU | 4121 | ACCAGGUUUAGUCUCCAGG | | [907-925] 3'UTR |
| 59 | 3765 | GGCCAUUUUGAAUAAAGAG | 4122 | CUCUUUAUUCAAAAUGGCC | Chp | [262-280] 5'UTR |
| 60 | 3766 | CUUUCUGUAACAAUGCGAU | 4123 | AUCGCAUUGUUACAGAAAG | Chp | [1198-1216] 3'UTR |
| 61 | 3767 | GAAGUUAAUGGUUUUGAGU | 4124 | ACUCAAAACCAUUAACUUC | | [72-90] 5'UTR |
| 62 | 3768 | GCUCUCCAAACAUAUGCCAA | 4125 | UUGGCAUAUGUUUGGAGAGC | Chp | [1068-1086] 3'UTR |
| 63 | 3769 | UGUCAUCUCCAACGACAAA | 4126 | UUUGUCGUUGGAGAUGACA | Chp | [729-747] ORF |
| 64 | 3770 | UAGCCAGGUGGAAAUCCUA | 4127 | UAGGAUUUCCACCUGGCUA | Chp | [597-615] ORF |
| 65 | 3771 | CUGCCAGGAAAAAGCAAAU | 4128 | AUUUGCUUUUUCCUGGCAG | Chp | [49-67] 5'UTR |
| 66 | 3772 | CACUGUAGCGGGACUUCUU | 4129 | AAGAAGUCCCGCUACAGUG | | [342-360] 5'UTR |
| 67 | 3773 | GGCAGGGAAGCUCAAAGAU | 4130 | AUCUUUGAGCUUCCCUGCC | | [22-40] 5'UTR |
| 68 | 3774 | UGUGAACUUGUGGCCUGAA | 4131 | UUCAGGCCACAAGUUCACA | Chp | [943-961] 3'UTR |
| 69 | 3775 | UGUCCUGACACCUCCAGAA | 4132 | UUCUGGAGGUGUCAGGACA | | [774-792] 3'UTR |
| 70 | 3776 | UUGUCAUCUCCAACGACAA | 4133 | UUGUCGUUGGAGAUGACAA | Chp | [728-746] ORF |
| 71 | 3777 | CAGGAAAAAGCAAAUUCUG | 4134 | CAGAAUUUGCUUUUUCCUG | Chp | [53-71] 5'UTR |
| 72 | 3778 | GGGACUUCUUUUGGUUUUC | 4135 | GAAAACCAAAAGAAGUCCC | | [351-369] 5'UTR |
| 73 | 3779 | AGGAAGGUGACUUUCUGUA | 4136 | UACAGAAAGUCACCUUCCU | Rat,Ms,Chp | [1188-1206] 3'UTR |
| 74 | 3780 | GGCUGCUCUCCAAACUAUG | 4137 | CAUAGUUUGGAGAGCAGCC | Chp | [1064-1082] 3'UTR |
| 75 | 3781 | CUUGCUGGACGACAUGAAC | 4138 | GUUCAUGUCGUCCAGCAAG | Chp | [522-540] ORF |
| 76 | 3782 | UGCUGCCAGGAAAAAGCAA | 4139 | UUGCUUUUUCCUGGCAGCA | | [47-65] 5'UTR |
| 77 | 3783 | GUUCUAAGGUCUCUUCAGA | 4140 | UCUGAAGAGACCUUAGAAC | | [1024-1042] 3'UTR |
| 78 | 3784 | CAGCGCUUCCUCAUUCUUU | 4141 | AAAGAAUGAGGAAGCGCUG | Chp | [137-155] 5'UTR |
| 79 | 3785 | GACUAAACCUGGUGCUCAG | 4142 | CUGAGCACCAGGUUUAGUC | | [913-931] 3'UTR |
| 80 | 3786 | GGAGCUUUUGCCACUGACU | 4143 | AGUCAGUGGCAAAAGCUCC | Chp | [749-767] |
| 81 | 3787 | UUCCAGGCAGGCUCUAUAA | 4144 | UUAUAGAGCCUGCCUGGAA | | [288-306] 5'UTR |
| 82 | 3788 | UGUACCUUUUUUACAGGAA | 4145 | UUCCUGUAAAAAAGGUACA | Ms,Chp | [1174-1192] 3'UTR |
| 83 | 3789 | GUGGCUGCUCUCCAAACUA | 4146 | UAGUUUGGAGAGCAGCCAC | Chp | [1062-1080] 3'UTR |
| 84 | 3790 | CACCAAAUCCCUUCCUGGA | 4147 | UCCAGGAAGGGAUUUGGUG | | [894-912] 3'UTR |
| 85 | 3791 | CCGGAACUUGUCAUCUCCA | 4148 | UGGAGAUGACAAGUUCCGG | Chp | [721-739] ORF |
| 86 | 3792 | GCGUCAUCGACUACAUUCU | 4149 | AGAAUGUAGUCGAUGACGC | Chp | [620-638] ORF |
| 87 | 3793 | AGCGCGUCAUCGACUACAU | 4150 | AUGUAGUCGAUGACGCGCU | GP,Chn,Chp | [617-635] ORF |
| 88 | 3794 | UCAGCUUAGCCAGGUGGAA | 4151 | UUCCACCUGGCUAAGCUGA | Rat,Ms,GP,Chp | [591-609] ORF |
| 89 | 3795 | CAGGCAGGCUCUAUAAGUG | 4152 | CACUUAUAGAGCCUGCCUG | | [291-309] 5'UTR |
| 90 | 3796 | GUCUUCUGGUCUCCUUGGA | 4153 | UCCAAGGAGACCAGAAGAC | Chp | [1103-1121] 3'UTR |
| 91 | 3797 | CCAAGUUCUAAGGUCUCUU | 4154 | AAGAGACCUUAGAACUUGG | | [1020-1038] 3'UTR |
| 92 | 3798 | AGCGAAGGACGUGAACUU | 4155 | AAGUUCACAGUCCUUCGCU | Chp | [933-951] 3'UTR |
| 93 | 3799 | AUCCCUUCCUGGAGACUAA | 4156 | UUAGUCUCCAGGAAGGGAU | | [900-918] 3'UTR |
| 94 | 3800 | CUGUAGCGGGACUUCUUUU | 4157 | AAAAGAAGUCCCGCUACAG | | [344-362] 5'UTR |
| 95 | 3801 | ACUGUAGCGGGACUUCUUU | 4158 | AAAGAAGUCCCGCUACAGU | | [343-361] 5'UTR |
| 96 | 3802 | GAGUAUAUAGGUUUUGUAC | 4159 | GUACAAAACCUAUAUACUC | Chp | [1160-1178] 3'UTR |
| 97 | 3803 | CUCACUCCGGAACUUGUCA | 4160 | UGACAAGUUCCGGAGUGAG | | [715-733] ORF |
| 98 | 3804 | ACUACAUUCUCGACCUGCA | 4161 | UGCAGGUCGAGAAUGUAGU | Chp | [629-647] ORF |

FIGURE 4 Continued

| | | | | | | | |
|---|---|---|---|---|---|---|---|
| 99 | 3805 | GGAGACUAAACCUGGUGCU | 4162 | AGCACCAGGUUUAGUCUCC | | | [910-928] 3'UTR |
| 100 | 3806 | AGCGCUUCCUCAUUCUUUG | 4163 | CAAAGAAUGAGGAAGCGCU | Chp | | [138-156] 5'UTR |
| 101 | 3807 | UCUGGUCUCCUUGGAGAAA | 4164 | UUUCUCCAAGGAGACCAGA | Chp | | [1107-1125] 3'UTR |
| 102 | 3808 | CAACGACAAAAGGAGCUUU | 4165 | AAAGCUCCUUUUGUCGUUG | Chp | | [738-756] ORF |
| 103 | 3809 | GGCAGGCUCUAUAAGUGAC | 4166 | GUCACUUAUAGAGCCUGCC | | | [293-311] 5'UTR |
| 104 | 3810 | GCUUCCUCAUUCUUUGAAU | 4167 | AUUCAAAGAAUGAGGAAGC | Chp | | [141-159] 5'UTR |
| 105 | 3811 | GUACCUUUUUUACAGGAAG | 4168 | CUUCCUGUAAAAAAGGUAC | Ms,Chp | | [1175-1193] 3'UTR |
| 106 | 3812 | UGUUGCCCUGAUUUAUGAA | 4169 | UUCAUAAAUCAGGGCAACA | Chp | | [1131-1149] 3'UTR |
| 107 | 3813 | CUUCUGGUCUCCUUGGAGA | 4170 | UCUCCAAGGAGACCAGAAG | Chp | | [1105-1123] 3'UTR |
| 108 | 3814 | AAGCAAAUUCUGGAAGUUA | 4171 | UAACUUCCAGAAUUUGCUU | Chp | | [60-78] 5'UTR |
| 109 | 3815 | GAAAUCCUACAGCGCGUCA | 4172 | UGACGCGCUGUAGGAUUUC | Chp | | [607-625] ORF |
| 110 | 3816 | GACAUGAACCACUGCUACU | 4173 | AGUAGCAGUGGUUCAUGUC | Rat,Ms,GP,Chn,Chp | | [532-550] ORF |
| 111 | 3817 | GGUUUUCUUUCUCUUUGGG | 4174 | CCCAAAGAGAAAGAAAACC | | | [363-381] 5'UTR |
| 112 | 3818 | CAGGAAGGUGACUUUCUGU | 4175 | ACAGAAAGUCACCUUCCUG | Rat,Ms,Chp | | [1187-1205] 3'UTR |
| 113 | 3819 | GUUAAUGGUUUUGAGUGAU | 4176 | AUCACUCAAAACCAUUAAC | Chp | | [75-93] 5'UTR |
| 114 | 3820 | GUGAACUUGUGGCCUGAAG | 4177 | CUUCAGGCCACAAGUUCAC | Chp | | [944-962] 3'UTR |
| 115 | 3821 | AGGCGGGCCAUUUUGAAUA | 4178 | UAUUCAAAAUGGCCCGCCU | Chp | | [257-275] 5'UTR |
| 116 | 3822 | GUGCUGCCAGGAAAAAGCA | 4179 | UGCUUUUUCCUGGCAGCAC | | | [46-64] 5'UTR |
| 117 | 3823 | AAGUUCUAAGGUCUCUUCA | 4180 | UGAAGAGACCUUAGAACUU | | | [1022-1040] 3'UTR |
| 118 | 3824 | CGACUACAUUCUCGACCUG | 4181 | CAGGUCGAGAAUGUAGUCG | Chp | | [627-645] ORF |
| 119 | 3825 | GAGCGAAGGACUGUGAACU | 4182 | AGUUCACAGUCCUUCGCUC | Chp | | [932-950] 3'UTR |
| 120 | 3826 | CUUGUCAUCUCCAACGACA | 4183 | UGUCGUUGGAGAUGACAAG | Chp | | [727-745] ORF |
| 121 | 3827 | GAAUAAAGAGGCGUGCCUU | 4184 | AAGGCACGCCUCUUUAUUC | Chp | | [271-289] 5'UTR |
| 122 | 3828 | AGGGAAGCUCAAAGAUCUG | 4185 | CAGAUCUUUGAGCUUCCCU | | | [25-43] 5'UTR |
| 123 | 3829 | GGAACUUGUCAUCUCCAAC | 4186 | GUUGGAGAUGACAAGUUCC | Chp | | [723-741] ORF |
| 124 | 3830 | AAAAGCAAAUUCUGGAAGU | 4187 | ACUUCCAGAAUUUGCUUUU | Chp | | [58-76] 5'UTR |
| 125 | 3831 | UGGUUUUCUUUCUCUUUGG | 4188 | CCAAAGAGAAAGAAAACCA | | | [362-380] 5'UTR |
| 126 | 3832 | AACUUGUCAUCUCCAACGA | 4189 | UCGUUGGAGAUGACAAGUU | Chp | | [725-743] ORF |
| 127 | 3833 | AGCUCACUCCGGAACUUGU | 4190 | ACAAGUUCCGGAGUGAGCU | Rat,Ms | | [713-731] ORF |
| 128 | 3834 | CAUUCUCGACCUGCAGGUA | 4191 | UACCUGCAGGUCGAGAAUG | Chp | | [633-651] ORF |
| 129 | 3835 | UAGCGGGACUUCUUUUGGU | 4192 | ACCAAAAGAAGUCCCGCUA | | | [347-365] 5'UTR |
| 130 | 3836 | UGGCUCCUUGGAGAAAGG | 4193 | CCUUUCUCCAAGGAGCCA | Chp | | [1109-1127] 3'UTR |
| 131 | 3837 | UUCUGGUCUCCUUGGAGAA | 4194 | UUCUCCAAGGACCAGAA | Chp | | [1106-1124] 3'UTR |
| 132 | 3838 | AGUGGCUGCUCUCCAAACU | 4195 | AGUUUGGAGAGCAGCCACU | Chp | | [1061-1079] 3'UTR |
| 133 | 3839 | AAUUCUGGAAGUUAAUGGU | 4196 | ACCAUUAACUUCCAGAAUU | Chp | | [65-83] 5'UTR |
| 134 | 3840 | ACAAAAGGAGCUUUUGCCA | 4197 | UGGCAAAAGCUCCUUUUGU | Chp | | [743-761] ORF |
| 135 | 3841 | UGCUGGACGACAUGAACCA | 4198 | UGGUUCAUGUCGUCCAGCA | Chp | | [524-542] ORF |
| 136 | 3842 | UAAAGAGGCGUGCCUUCCA | 4199 | UGGAAGGCACGCCUCUUUA | | | [274-292] 5'UTR |
| 137 | 3843 | AUUUAAGCGGGCUGUGAAC | 4200 | GUUCACAGCCCGCUUAAAU | Chp | | [212-230] 5'UTR |
| 138 | 3844 | CGCUUCCUCAUUCUUUGAA | 4201 | UUCAAAGAAUGAGGAAGCG | Chp | | [140-158] 5'UTR |
| 139 | 3845 | GGAAGCUCAAAGAUCUGGG | 4202 | CCCAGAUCUUUGAGCUUCC | Chp | | [27-45] 5'UTR |
| 140 | 3846 | GUAUCAGCGCUUCCUCAUU | 4203 | AAUGAGGAAGCGCUGAUAC | Chp | | [133-151] 5'UTR |
| 141 | 3847 | ACACUUGUGUAUAUGAUGA | 4204 | UCAUCAUAUACACAAGUGU | | | [1270-1288] 3'UTR |
| 142 | 3848 | ACUUUCUGUAACAAUGCGA | 4205 | UCGCAUUGUUACAGAAAGU | Chp | | [1197-1215] 3'UTR |
| 143 | 3849 | CCAACGACAAAAGGAGCUU | 4206 | AAGCUCCUUUUGUCGUUGG | Chp | | [737-755] ORF |
| 144 | 3850 | UCAUCGACUACAUUCUCGA | 4207 | UCGAGAAUGUAGUCGAUGA | Chp | | [623-641] ORF |
| 145 | 3851 | UGGAAAUCCUACAGCGCGU | 4208 | ACGCGCUGUAGGAUUUCCA | Chp | | [605-623] ORF |
| 146 | 3852 | AGCUUGCUGGACGACAUGA | 4209 | UCAUGUCGUCCAGCAAGCU | Chp | | [520-538] ORF |
| 147 | 3853 | CAUUUUGAAUAAAGAGGCG | 4210 | CGCCUCUUUAUUCAAAAUG | Chp | | [265-283] 5'UTR |
| 148 | 3854 | AAAGCAAAUUCUGGAAGUU | 4211 | AACUUCCAGAAUUUGCUUU | Chp | | [59-77] 5'UTR |
| 149 | 3855 | UUUACAGGAAGGUGACUUU | 4212 | AAAGUCACCUUCCUGUAAA | Rat,Ms,Chp | | [1183-1201] 3'UTR |
| 150 | 3856 | GGUUUUGUACCUUUUUUAC | 4213 | GUAAAAAAGGUACAAAACC | Chp | | [1169-1187] 3'UTR |
| 151 | 3857 | AGGUUCUGUUGCCCUGAUU | 4214 | AAUCAGGGCAACAGAACCU | Chp | | [1125-1143] 3'UTR |
| 152 | 3858 | UGGAAGUUAAUGGUUUUGA | 4215 | UCAAAACCAUUAACUUCCA | Chp | | [70-88] 5'UTR |
| 153 | 3859 | UCCCUUCCUGGAGACUAAA | 4216 | UUUAGUCUCCAGGAAGGGA | | | [901-919] 3'UTR |
| 154 | 3860 | AGGUGGAAAUCCUACAGCG | 4217 | CGCUGUAGGAUUUCCACCU | Chp | | [602-620] ORF |
| 155 | 3861 | AGGAAAAAGCAAAUUCUGG | 4218 | CCAGAAUUUGCUUUUUCCU | Chp | | [54-72] 5'UTR |
| 156 | 3862 | GCAAUUAAGCGGGCUGUG | 4219 | CACAGCCCGCUUAAAUUGC | Chp | | [209-227] 5'UTR |
| 157 | 3863 | GGAAGCCUGUUUGCAAUUU | 4220 | AAAUUGCAAACAGGCUUCC | Chp | | [197-215] 5'UTR |
| 158 | 3864 | CUCCUUGGAGAAAGGUUCU | 4221 | AGAACCUUUCUCCAAGGAG | Chp | | [1113-1131] 3'UTR |
| 159 | 3865 | AGGAAGCCUGUUUGCAAUU | 4222 | AAUUGCAAACAGGCUUCCU | Chp | | [196-214] 5'UTR |
| 160 | 3866 | UUCUGUUGCCCUGAUUUAU | 4223 | AUAAAUCAGGGCAACAGAA | Chp | | [1128-1146] 3'UTR |

FIGURE 4 Continued

| | | | | | | | |
|---|---|---|---|---|---|---|---|
| 161 | 3867 | AGAGCUGGUCUUCUGGUCU | 4224 | AGACCAGAAGACCAGCUCU | Chp | [1096-1114] 3'UTR |
| 162 | 3868 | UUCUGGAAGUUAAUGGUUU | 4225 | AAACCAUUAACUUCCAGAA | Chp | [67-85] 5'UTR |
| 163 | 3869 | AAAUCCUACAGCGCGUCAU | 4226 | AUGACGCGCUGUAGGAUUU | Chp | [608-626] ORF |
| 164 | 3870 | UUAAAUCCUUGCUGGCGGA | 4227 | UCCGCCAGCAAGGAUUUAA | Chp | [96-114] 5'UTR |
| 165 | 3871 | GAAAGGUUCUGUUGCCCUG | 4228 | CAGGGCAACAGAACCUUUC | Chp | [1122-1140] 3'UTR |
| 166 | 3872 | UAAGGUCUCUUCAGAGCGU | 4229 | ACGCUCUGAAGAGACCUUA | | [1028-1046] 3'UTR |
| 167 | 3873 | AACGACAAAAGGAGCUUUU | 4230 | AAAAGCUCCUUUUGUCGUU | Chp | [739-757] ORF |
| 168 | 3874 | GUCAUCUCCAACGACAAAA | 4231 | UUUUGUCGUUGGAGAUGAC | Chp | [730-748] ORF |
| 169 | 3875 | CCAGGUGGAAAUCCUACAG | 4232 | CUGUAGGAUUUCCACCUGG | Chp | [600-618] ORF |
| 170 | 3876 | CCAUUUUGAAUAAAGAGGC | 4233 | GCCUCUUUAUUCAAAAUGG | Chp | [264-282] 5'UTR |
| 171 | 3877 | UCAGCGCUUCCUCAUUCUU | 4234 | AAGAAUGAGGAAGCGCUGA | Chp | [136-154] 5'UTR |
| 172 | 3878 | GGAGAAAGGUUCUGUUGCC | 4235 | GGCAACAGAACCUUUCUCC | Chp | [1119-1137] 3'UTR |
| 173 | 3879 | UGCCCACUUGACUUCACCA | 4236 | UGGUGAAGUCAAGUGGGCA | Chp | [880-898] 3'UTR |
| 174 | 3880 | CUACAUUCUCGACCUGCAG | 4237 | CUGCAGGUCGAGAAUGUAG | Chp | [630-648] ORF |
| 175 | 3881 | GCAGGGAAGCUCAAAGAUC | 4238 | GAUCUUUGAGCUUCCCUGC | | [23-41] 5'UTR |
| 176 | 3882 | AAAUCCUUGCUGGCGGAGA | 4239 | UCUCCGCCAGCAAGGAUUU | Chp | [98-116] 5'UTR |
| 177 | 3883 | GUAUAUAGGUUUUGUACCU | 4240 | AGGUACAAAACCUAUAUAC | Chp | [1162-1180] 3'UTR |
| 178 | 3884 | AAGGUUCUGUUGCCCUGAU | 4241 | AUCAGGGCAACAGAACCUU | Chp | [1124-1142] 3'UTR |
| 179 | 3885 | GACUGUGAACUUGUGGCCU | 4242 | AGGCCACAAGUUCACAGUC | Chp | [940-958] 3'UTR |
| 180 | 3886 | UUGACUUCACCAAAUCCCU | 4243 | AGGGAUUUGGUGAAGUCAA | | [887-905] 3'UTR |
| 181 | 3887 | GGUCUCCUUGGAGAAAGGU | 4244 | ACCUUUCUCCAAGGAGACC | Chp | [1110-1128] 3'UTR |
| 182 | 3888 | UGGUCUUCUGGUCUCCUUG | 4245 | CAAGGAGACCAGAAGACCA | Chp | [1101-1119] 3'UTR |
| 183 | 3889 | UGCUCUCCAAACUAUGCCA | 4246 | UGGCAUAGUUUGGAGAGCA | Chp | [1067-1085] 3'UTR |
| 184 | 3890 | UAAACCUGGUGCUCAGGAG | 4247 | CUCCUGAGCACCAGGUUUA | | [916-934] 3'UTR |
| 185 | 3891 | CUUCCUGGAGACUAAACCU | 4248 | AGGUUUAGUCUCCAGGAAG | | [904-922] 3'UTR |
| 186 | 3892 | UCACUCCGGAACUUGUCAU | 4249 | AUGACAAGUUCCGGAGUGA | | [716-734] ORF |
| 187 | 3893 | UUUGUUUUCUUUCUCUUUG | 4250 | CAAAGAGAAAGAAAACCAA | | [361-379] 5'UTR |
| 188 | 3894 | GCCUGUUUGCAAUUUAAGC | 4251 | GCUUAAAUUGCAAACAGGC | Chp | [201-219] 5'UTR |
| 189 | 3895 | GACUUUCUGUAACAAUGCG | 4252 | CGCAUUGUUACAGAAAGUC | Chp | [1196-1214] 3'UTR |
| 190 | 3896 | AAAGGUUCUGUUGCCCUGA | 4253 | UCAGGGCAACAGAACCUUU | Chp | [1123-1141] 3'UTR |
| 191 | 3897 | CAAGUUCUAAGGUCUCUUC | 4254 | GAAGAGACCUUAGAACUUG | | [1021-1039] 3'UTR |
| 192 | 3898 | AGACUAAACCUGGUGCUCA | 4255 | UGAGCACCAGGUUUAGUCU | | [912-930] 3'UTR |
| 193 | 3899 | UGACUUCACCAAAUCCCUU | 4256 | AAGGGAUUUGGUGAAGUCA | | [888-906] 3'UTR |
| 194 | 3900 | AGGAGCUUUUGCCACUGAC | 4257 | GUCAGUGGCAAAAGCUCCU | Ms,Chp | [748-766] |
| 195 | 3901 | AAGGAGCUUUUGCCACUGA | 4258 | UCAGUGGCAAAAGCUCCUU | Chp | [747-765] ORF |
| 196 | 3902 | CGACAAAAGGAGCUUUUGC | 4259 | GCAAAAGCUCCUUUUGUCG | Chp | [741-759] ORF |
| 197 | 3903 | UACAGGAAGGUGACUUUCU | 4260 | AGAAAGUCACCUUCCUGUA | Rat,Ms,Chp | [1185-1203] 3'UTR |
| 198 | 3904 | AGUUCUAAGGUCUCUUCAG | 4261 | CUGAAGAGACCUUAGAACU | | [1023-1041] 3'UTR |
| 199 | 3905 | CUCCGGAACUUGUCAUCUC | 4262 | GAGAUGACAAGUUCCGGAG | Chp | [719-737] ORF |
| 200 | 3906 | GACGACAUGAACCACUGCU | 4263 | AGCAGUGGUUCAUGUCGUC | Rat,Ms,GP,Chn,Chp | [529-547] ORF |
| 201 | 3907 | AAAAGGAGCUUUUGCCACU | 4264 | AGUGGCAAAAGCUCCUUUU | Chp | [745-763] ORF |
| 202 | 3908 | AAUCCUACAGCGCGUCAUC | 4265 | GAUGACGCGCUGUAGGAUU | Chp | [609-627] ORF |
| 203 | 3909 | AGCCUGUUUGCAAUUUAAG | 4266 | CUUAAAUUGCAAACAGGCU | Chp | [200-218] 5'UTR |
| 204 | 3910 | AUCAGCGCUUCCUCAUUCU | 4267 | AGAAUGAGGAAGCGCUGAU | Chp | [135-153] 5'UTR |
| 205 | 3911 | UUUUUUACAGGAAGGUGAC | 4268 | GUCACCUUCCUGUAAAAAA | Rat,Ms,Chp | [1180-1198] 3'UTR |
| 206 | 3912 | CCUUGGAGAAAGGUUCUGU | 4269 | ACAGAACCUUUCUCCAAGG | Chp | [1115-1133] 3'UTR |
| 207 | 3913 | GCUGCUCUCCAAACUAUGC | 4270 | GCAUAGUUUGGAGAGCAGC | Chp | [1065-1083] 3'UTR |
| 208 | 3914 | GCCAUUUUGAAUAAAGAGG | 4271 | CCUCUUUAUUCAAAAUGGC | Chp | [263-281] 5'UTR |
| 209 | 3915 | CUGGUCUCCUUGGAGAAAG | 4272 | CUUUCUCCAAGGAGACCAG | Chp | [1108-1126] 3'UTR |
| 210 | 3916 | CUAAACCUGGUGCUCAGGA | 4273 | UCCUGAGCACCAGGUUUAG | | [915-933] 3'UTR |
| 211 | 3917 | CAAAUUCUGGAAGUUAAUG | 4274 | CAUUAACUUCCAGAAUUUG | Chp | [63-81] 5'UTR |
| 212 | 3918 | UUCUCGACCUGCAGGUAGU | 4275 | ACUACCUGCAGGUCGAGAA | | [635-653] ORF |
| 213 | 3919 | CAUCGACUACAUUCUCGAC | 4276 | GUCGAGAAUGUAGUCGAUG | | [624-642] ORF |
| 214 | 3920 | GCUUAGCCAGGUGGAAAUC | 4277 | GAUUUCCACCUGGCUAAGC | Rat,Ms,GP,Chn,Chp | [594-612] ORF |
| 215 | 3921 | UGGACGACAUGAACCACUG | 4278 | CAGUGGUUCAUGUCGUCCA | Rat,Ms,GP,Chn,Chp | [527-545] ORF |
| 216 | 3922 | GAUUUUUAAAUCCUUGCUG | 4279 | CAGCAAGGAUUUAAAAAUC | Chp | [91-109] 5'UTR |
| 217 | 3923 | GUCUCCUUGGAGAAAGGUU | 4280 | AACCUUUCUCCAAGGAGAC | Chp | [1111-1129] 3'UTR |
| 218 | 3924 | CUCUCCAAACUAUGCCAAG | 4281 | CUUGGCAUAGUUUGGAGAG | Chp | [1069-1087] 3'UTR |
| 219 | 3925 | UCAUCUCCAACGACAAAAG | 4282 | CUUUUGUCGUUGGAGAUGA | Chp | [731-749] ORF |
| 220 | 3926 | CACUCCGGAACUUGUCAUC | 4283 | GAUGACAAGUUCCGGAGUG | | [717-735] ORF |
| 221 | 3927 | CGUCAUCGACUACAUUCUC | 4284 | GAGAAUGUAGUCGAUGACG | Chp | [621-639] ORF |
| 222 | 3928 | CCUCAUUCUUUGAAUCCGC | 4285 | GCGGAUUCAAAGAAUGAGG | | [145-163] 5'UTR |

FIGURE 4 Continued

| | | | | | | |
|---|---|---|---|---|---|---|
| 223 | 3929 | AUCUCCAACGACAAAAGGA | 4286 | UCCUUUUGUCGUUGGAGAU | Chp | [733-751] ORF |
| 224 | 3930 | CGCGUCAUCGACUACAUUC | 4287 | GAAUGUAGUCGAUGACGCG | Chp | [619-637] ORF |
| 225 | 3931 | GUAGCGGGACUUCUUUUGG | 4288 | CCAAAAGAAGUCCCGCUAC | | [346-364] 5'UTR |
| 226 | 3932 | CUCAUUCUUUGAAUCCGCG | 4289 | CGCGGAUUCAAAGAAUGAG | | [146-164] 5'UTR |
| 227 | 3933 | UCUGUUGCCCUGAUUUAUG | 4290 | CAUAAAUCAGGGCAACAGA | Chp | [1129-1147] 3'UTR |
| 228 | 3934 | CCCAAGUUCUAAGGUCUCU | 4291 | AGAGACCUUAGAACUUGGG | | [1019-1037] 3'UTR |
| 229 | 3935 | UCUCCAACGACAAAAGGAG | 4292 | CUCCUUUUGUCGUUGGAGA | Chp | [734-752] ORF |
| 230 | 3936 | UGGAGAAAGGUUCUGUUGC | 4293 | GCAACAGAACCUUUCUCCA | Chp | [1118-1136] 3'UTR |
| 231 | 3937 | UGAAGAGCCAGAGCUAGCU | 4294 | AGCUAGCUCUGGCUCUUCA | Chp | [958-976] 3'UTR |
| 232 | 3938 | UCGACUACAUUCUCGACCU | 4295 | AGGUCGAGAAUGUAGUCGA | Chp | [626-644] ORF |
| 233 | 3939 | UUAGCCAGGUGGAAAUCCU | 4296 | AGGAUUUCCACCUGGCUAA | Rat,Ms,GP,Chn,Chp | [596-614] ORF |
| 234 | 3940 | AAUAAAGAGGCGUGCCUUC | 4297 | GAAGGCACGCCUCUUUAUU | Chp | [272-290] 5'UTR |
| 235 | 3941 | UGAAUAAAGAGGCGUGCCU | 4298 | AGGCACGCCUCUUUAUUCA | Chp | [270-288] 5'UTR |
| 236 | 3942 | GGGAAGCUCAAAGAUCUGG | 4299 | CCAGAUCUUUGAGCUUCCC | Chp | [26-44] 5'UTR |
| 237 | 3943 | UGACUUUCUGUAACAAUGC | 4300 | GCAUUGUUACAGAAAGUCA | Chp | [1195-1213] 3'UTR |
| 238 | 3944 | ACUGUGAACUUGUGGCCUG | 4301 | CAGGCCACAAGUUCACAGU | Chp | [941-959] 3'UTR |
| 239 | 3945 | CUGGACGACAUGAACCACU | 4302 | AGUGGUUCAUGUCGUCCAG | GP,Chn,Chp | [526-544] ORF |
| 240 | 3946 | AUUCUGGAAGUUAAUGGUU | 4303 | AACCAUUAACUUCCAGAAU | Chp | [66-84] 5'UTR |
| 241 | 3947 | CAAAUCCCUUCCUGGAGAC | 4304 | GUCUCCAGGAAGGGAUUUG | | [897-915] 3'UTR |
| 242 | 3948 | CAAAAGGAGCUUUUGCCAC | 4305 | GUGGCAAAAGCUCCUUUUG | Chp | [744-762] ORF |
| 243 | 3949 | CAGGUGGAAAUCCUACAGC | 4306 | GCUGUAGGAUUUCCACCUG | Chp | [601-619] ORF |
| 244 | 3950 | GUUUGCAAUUUAAGCGGGC | 4307 | GCCCGCUUAAAUUGCAAAC | Chp | [205-223] 5'UTR |
| 245 | 3951 | AGCCAGGUGGAAAUCCUAC | 4308 | GUAGGAUUUCCACCUGGCU | Chp | [598-616] ORF |
| 246 | 3952 | AAUCCCUUCCUGGAGACUA | 4309 | UAGUCUCCAGGAAGGGAUU | | [899-917] 3'UTR |
| 247 | 3953 | UGUAGCGGGACUUCUUUUG | 4310 | CAAAAGAAGUCCCGCUACA | | [345-363] 5'UTR |
| 248 | 3954 | AGAAAGGUUCUGUUGCCCU | 4311 | AGGGCAACAGAACCUUUCU | Chp | [1121-1139] 3'UTR |
| 249 | 3955 | UCUCCAAACUAUGCCAAGG | 4312 | CCUUGGCAUAGUUUGGAGA | Chp | [1070-1088] 3'UTR |
| 250 | 3956 | AGGACUGUGAACUUGUGGC | 4313 | GCCACAAGUUCACAGUCCU | Chp | [938-956] 3'UTR |
| 251 | 3957 | ACUUGUCAUCUCCAACGAC | 4314 | GUCGUUGGAGAUGACAAGU | Chp | [726-744] ORF |
| 252 | 3958 | CAUUCUUUGAAUCCGCGGC | 4315 | GCCGCGGAUUCAAAGAAUG | | [148-166] 5'UTR |
| 253 | 3959 | UUGUACCUUUUUUACAGGA | 4316 | UCCUGUAAAAAAGGUACAA | Ms,Chp | [1173-1191] 3'UTR |
| 254 | 3960 | AAGUUAAUGGUUUUGAGUG | 4317 | CACUCAAAACCAUUAACUU | Chp | [73-91] 5'UTR |
| 255 | 3961 | UCACCAAAUCCCUUCCUGG | 4318 | CCAGGAAGGGAUUUGGUGA | | [893-911] 3'UTR |
| 256 | 3962 | CAUCUCCAACGACAAAAGG | 4319 | CCUUUUGUCGUUGGAGAUG | Chp | [732-750] ORF |
| 257 | 3963 | ACAUUCCGACCUGCAGGU | 4320 | ACCUGCAGGUCGGAAUGU | Chp | [632-650] ORF |
| 258 | 3964 | UCACUGUAGCGGGACUUCU | 4321 | AGAAGUCCCGCUACAGUGA | | [341-359] 5'UTR |
| 259 | 3965 | UUUCUGUAACAAUGCGAUG | 4322 | CAUCGCAUUGUUACAGAAA | Chp | [1199-1217] 3'UTR |
| 260 | 3966 | UCUUCUGGUCUCCUUGGAG | 4323 | CUCCAAGGAGACCAGAAGA | Chp | [1104-1122] 3'UTR |
| 261 | 3967 | ACUCCGGAACUUGUCAUCU | 4324 | AGAUGACAAGUUCCGGAGU | | [718-736] ORF |
| 262 | 3968 | GCCAGGAAAAAGCAAAUUC | 4325 | GAAUUUGCUUUUUCCUGGC | Chp | [51-69] 5'UTR |
| 263 | 3969 | UUUUGAAUAAAGAGGCGUG | 4326 | CACGCCUCUUUAUUCAAAA | Chp | [267-285] 5'UTR |
| 264 | 3970 | CUUCCUCAUUCUUUGAAUC | 4327 | GAUUCAAAGAAUGAGGAAG | Chp | [142-160] 5'UTR |
| 265 | 3971 | AACACUUGUGUAUAUGAUG | 4328 | CAUCAUAUACACAAGUGUU | | [1269-1287] 3'UTR |
| 266 | 3972 | UUUUUACAGGAAGGUGACU | 4329 | AGUCACCUUCCUGUAAAAA | Rat,Ms,Chp | [1181-1199] 3'UTR |
| 267 | 3973 | CCUUUUUUACAGGAAGGUG | 4330 | CACCUUCCUGUAAAAAAGG | Ms,Chp | [1178-1196] 3'UTR |
| 268 | 3974 | GCCCUGAUUUAUGAACUCU | 4331 | AGAGUUCAUAAAUCAGGGC | Chp | [1135-1153] 3'UTR |
| 269 | 3975 | CUGGAGACUAAACCUGGUG | 4332 | CACCAGGUUUAGUCUCCAG | | [908-926] 3'UTR |
| 270 | 3976 | CCUUCCUGGAGACUAAACC | 4333 | GGUUUAGUCUCCAGGAAGG | | [903-921] 3'UTR |
| 271 | 3977 | CUUCACCAAAUCCCUUCCU | 4334 | AGGAAGGGAUUUGGUGAAG | | [891-909] 3'UTR |
| 272 | 3978 | ACGACAAAAGGAGCUUUUG | 4335 | CAAAAGCUCCUUUUGUCGU | Chp | [740-758] ORF |
| 273 | 3979 | CUCCAACGACAAAAGGAGC | 4336 | GCUCCUUUUGUCGUUGGAG | Chp | [735-753] ORF |
| 274 | 3980 | CUGUUUGCAAUUUAAGCGG | 4337 | CCGCUUAAAUUGCAAACAG | Chp | [203-221] 5'UTR |
| 275 | 3981 | UACCUUUUUUACAGGAAGG | 4338 | CCUUCCUGUAAAAAAGGUA | Ms,Chp | [1176-1194] 3'UTR |
| 276 | 3982 | UUGGAGAAAGGUUCUGUUG | 4339 | CAACAGAACCUUUCUCCAA | Chp | [1117-1135] 3'UTR |
| 277 | 3983 | CUGGAAGUUAAUGGUUUUG | 4340 | CAAAACCAUUAACUUCCAG | Chp | [69-87] 5'UTR |
| 278 | 3984 | CUAAGGUCUCUUCAGAGCG | 4341 | CGCUCUGAAGAGACCUUAG | | [1027-1045] 3'UTR |
| 279 | 3985 | AAGAGCCAGAGCUAGCUCU | 4342 | AGAGCUAGCUCUGGCUCUU | Chp | [960-978] 3'UTR |
| 280 | 3986 | AAGGACUGUGAACUUGUGG | 4343 | CCACAAGUUCACAGUCCUU | Chp | [937-955] 3'UTR |
| 281 | 3987 | UCCUGGAGACUAAACCUGG | 4344 | CCAGGUUUAGUCUCCAGGA | | [906-924] 3'UTR |
| 282 | 3988 | AAAAAGCAAAUUCUGGAAG | 4345 | CUUCCAGAAUUUGCUUUUU | Chp | [57-75] 5'UTR |
| 283 | 3989 | ACAUGAACCACUGCUACUC | 4346 | GAGUAGCAGUGGUUCAUGU | Rat,Ms,GP,Chn,Chp | [533-551] ORF |
| 284 | 3990 | GCAGGCUCUAUAAGUGACC | 4347 | GGUCACUUAUAGAGCCUGC | | [294-312] 5'UTR |

FIGURE 4 Continued

| | | | | | | | |
|---|---|---|---|---|---|---|---|
| 285 | 3991 | AUUCUUUGAAUCCGCGGCU | 4348 | AGCCGCGGAUUCAAAGAAU | | | [149-167] 5'UTR |
| 286 | 3992 | GUGAUUUUUAAAUCCUUGC | 4349 | GCAAGGAUUAAAAAUCAC | Chp | | [89-107] 5'UTR |
| 287 | 3993 | UGCCCUGAUUUAUGAACUC | 4350 | GAGUUCAUAAAUCAGGGCA | | | [1134-1152] 3'UTR |
| 288 | 3994 | GACAAAAGGAGCUUUUGCC | 4351 | GGCAAAAGCUCCUUUUGUC | | | [742-760] ORF |
| 289 | 3995 | UGCCAGGAAAAAGCAAAUU | 4352 | AAUUUGCUUUUUCCUGGCA | Chp | | [50-68] 5'UTR |
| 290 | 3996 | GAACUUGUCAUCUCCAACG | 4353 | CGUUGGAGAUGACAAGUUC | Chp | | [724-742] ORF |
| 291 | 3997 | UGUUUGCAAUUUAAGCGGG | 4354 | CCCGCUUAAAUUGCAAACA | Chp | | [204-222] 5'UTR |
| 292 | 3998 | UCUCCUUGGAGAAAGGUUC | 4355 | GAACCUUUCUCCAAGGAGA | Chp | | [1112-1130] 3'UTR |
| 293 | 3999 | AAAUUCUGGAAGUUAAUGG | 4356 | CCAUUAACUUCCAGAAUUU | Chp | | [64-82] 5'UTR |
| 294 | 4000 | ACCAAAUCCCUUCCUGGAG | 4357 | CUCCAGGAAGGGAUUUGGU | | | [895-913] 3'UTR |
| 295 | 4001 | UGCAAUUUAAGCGGGCUGU | 4358 | ACAGCCCGCUUAAAUUGCA | Chp | | [208-226] 5'UTR |
| 296 | 4002 | UCAUUCUUUGAAUCCGCGG | 4359 | CCGCGGAUUCAAAGAAUGA | | | [147-165] 5'UTR |
| 297 | 4003 | UUCUAAGGUCUCUUCAGAG | 4360 | CUCUGAAGAGACCUUAGAA | | | [1025-1043] 3'UTR |
| 298 | 4004 | CCCUUCCUGGAGACUAAAC | 4361 | GUUUAGUCUCCAGGAAGGG | | | [902-920] 3'UTR |
| 299 | 4005 | UCCGGAACUUGUCAUCUCC | 4362 | GGAGAUGACAAGUUCCGGA | Chp | | [720-738] ORF |
| 300 | 4006 | UUUGCAAUUUAAGCGGGCU | 4363 | AGCCCGCUUAAAUUGCAAA | Chp | | [206-224] 5'UTR |
| 301 | 4007 | GAGCUUUUGCCACUGACUC | 4364 | GAGUCAGUGGCAAAAGCUC | | | [750-768] |
| 302 | 4008 | CAUGAACCACUGCUACUCC | 4365 | GGAGUAGCAGUGGUUCAUG | Chp | | [534-552] ORF |
| 303 | 4009 | CAGGCUCUAUAAGUGACCG | 4366 | CGGUCACUUAUAGAGCCUG | | | [295-313] 5'UTR |
| 304 | 4010 | CCUGUUUGCAAUUUAAGCG | 4367 | CGCUUAAAUUGCAAACAGG | Chp | | [202-220] 5'UTR |
| 305 | 4011 | UUGCCCUGAUUUAUGAACU | 4368 | AGUUCAUAAAUCAGGGCAA | Chp | | [1133-1151] 3'UTR |
| 306 | 4012 | GAGACUAAACCUGGUGCUC | 4369 | GAGCACCAGGUUUAGUCUC | | | [911-929] 3'UTR |
| 307 | 4013 | UUCUGUAACAAUGCGAUGU | 4370 | ACAUCGCAUUGUUACAGAA | Chp | | [1200-1218] 3'UTR |
| 308 | 4014 | AAGGUCUCUUCAGAGCGUG | 4371 | CACGCUCUGAAGAGACCUU | | | [1029-1047] 3'UTR |
| 309 | 4015 | AAAGGAGCUUUUGCCACUG | 4372 | CAGUGGCAAAAGCUCCUUU | Chp | | [746-764] ORF |
| 310 | 4016 | GACUACAUUCUCGACCUGC | 4373 | GCAGGUCGAGAAUGUAGUC | | | [628-646] ORF |
| 311 | 4017 | GAGAAAGGUUCUGUUGCCC | 4374 | GGGCAACAGAACCUUUCUC | Chp | | [1120-1138] 3'UTR |
| 312 | 4018 | UUCACCAAAUCCCUUCCUG | 4375 | CAGGAAGGGAUUUGGUGAA | | | [892-910] 3'UTR |
| 313 | 4019 | ACUUCACCAAAUCCCUUCC | 4376 | GGAAGGGAUUUGGUGAAGU | | | [890-908] 3'UTR |
| 314 | 4020 | AUUUUUAAAUCCUUGCUGG | 4377 | CCAGCAAGGAUUUAAAAAU | Chp | | [92-110] 5'UTR |
| 315 | 4021 | CUUGACUUCACCAAAUCCC | 4378 | GGGAUUUGGUGAAGUCAAG | | | [886-904] 3'UTR |
| 316 | 4022 | AUUUUGAAUAAAGAGGCGU | 4379 | ACGCCUCUUUAUUCAAAAU | Chp | | [266-284] 5'UTR |
| 317 | 4023 | UCCUCAUUCUUUGAAUCCG | 4380 | CGGAUUCAAAGAAUGAGGA | | | [144-162] 5'UTR |
| 318 | 4024 | UUACAGGAAGGUGACUUUC | 4381 | GAAAGUCACCUUCCUGUAA | Rat,Ms,Chp | | [1184-1202] 3'UTR |
| 319 | 4025 | ACCUUUUUUACAGGAAGGU | 4382 | ACCUUCCUGUAAAAAAGGU | Ms,Chp | | [1177-1195] 3'UTR |
| 320 | 4026 | UACAUUCUCGACCUGCAGG | 4383 | CCUGCAGGUCGAGAAUGUA | Chp | | [631-649] ORF |
| 321 | 4027 | UUUUACAGGAAGGUGACUU | 4384 | AAGUCACCUUCCUGUAAAA | Rat,Ms,Chp | | [1182-1200] 3'UTR |
| 322 | 4028 | AGUAUAUAGGUUUUGUACC | 4385 | GGUACAAAACCUAUAUACU | Chp | | [1161-1179] 3'UTR |
| 323 | 4029 | UCCAAACUAUGCCAAGGCG | 4386 | CGCCUUGGCAUAGUUUGGA | Chp | | [1072-1090] 3'UTR |
| 324 | 4030 | GACUUCACCAAAUCCCUUC | 4387 | GAAGGGAUUUGGUGAAGUC | | | [889-907] 3'UTR |
| 325 | 4031 | ACUUGACUUCACCAAAUCC | 4388 | GGAUUUGGUGAAGUCAAGU | | | [885-903] 3'UTR |
| 326 | 4032 | GUUGCCCUGAUUUAUGAAC | 4389 | GUUCAUAAAUCAGGGCAAC | Chp | | [1132-1150] 3'UTR |
| 327 | 4033 | AGCUUUUGCCACUGACUCG | 4390 | CGAGUCAGUGGCAAAAGCU | Chp | | [751-769] |
| 328 | 4034 | UUGCUGGACGACAUGAACC | 4391 | GGUUCAUGUCGUCCAGCAA | Chp | | [523-541] ORF |
| 329 | 4035 | UUUGAAUAAAGAGGCGUGC | 4392 | GCACGCCUCUUUAUUCAAA | Chp | | [268-286] 5'UTR |
| 330 | 4036 | UCUAAGGUCUCUUCAGAGC | 4393 | GCUCUGAAGAGACCUUAGA | | | [1026-1044] 3'UTR |
| 331 | 4037 | UUGCAAUUUAAGCGGGCUG | 4394 | CAGCCCGCUUAAAUUGCAA | Chp | | [207-225] 5'UTR |
| 332 | 4038 | GUCAUCGACUACAUUCUCG | 4395 | CGAGAAUGUAGUCGAUGAC | Chp | | [622-640] ORF |
| 333 | 4039 | CUGCUCUCCAAACUAUGCC | 4396 | GGCAUAGUUUGGAGAGCAG | Chp | | [1066-1084] 3'UTR |
| 334 | 4040 | ACUAAACCUGGUGCUCAGG | 4397 | CCUGAGCACCAGGUUUAGU | | | [914-932] 3'UTR |
| 335 | 4041 | UGGAGACUAAACCUGGUGC | 4398 | GCACCAGGUUUAGUCUCCA | | | [909-927] 3'UTR |
| 336 | 4042 | AAAUCCCUUCCUGGAGACU | 4399 | AGUCUCCAGGAAGGGAUUU | | | [898-916] 3'UTR |
| 337 | 4043 | UCCAACGACAAAAGGAGCU | 4400 | AGCUCCUUUUGUCGUUGGA | Chp | | [736-754] ORF |
| 338 | 4044 | UAUCAGCGCUUCCUCAUUC | 4401 | GAAUGAGGAAGCGCUGAUA | Chp | | [134-152] 5'UTR |
| 339 | 4045 | UUUAAAUCCUUGCUGGCGG | 4402 | CCGCCAGCAAGGAUUUAAA | Chp | | [95-113] 5'UTR |
| 340 | 4046 | AUUCUCGACCUGCAGGUAG | 4403 | CUACCUGCAGGUCGAGAAU | Chp | | [634-652] ORF |
| 341 | 4047 | CUCCAAACUAUGCCAAGGC | 4404 | GCCUUGGCAUAGUUUGGAG | | | [1071-1089] 3'UTR |
| 342 | 4048 | UUUGUACCUUUUUUACAGG | 4405 | CCUGUAAAAAAGGUACAAA | Ms,Chp | | [1172-1190] 3'UTR |
| 343 | 4049 | UUCCUGGAGACUAAACCUG | 4406 | CAGGUUUAGUCUCCAGGAA | | | [905-923] 3'UTR |
| 344 | 4050 | AUGAACCACUGCUACUCCC | 4407 | GGGAGUAGCAGUGGUUCAU | Chp | | [535-553] ORF |
| 345 | 4051 | UUUUUAAAUCCUUGCUGGC | 4408 | GCCAGCAAGGAUUUAAAAA | Chp | | [93-111] 5'UTR |
| 346 | 4052 | AGGCUCUAUAAGUGACCGC | 4409 | GCGGUCACUUAUAGAGCCU | | | [296-314] 5'UTR |

FIGURE 4 Continued

| | | | | | | |
|---|---|---|---|---|---|---|
| 347 | 4053 | AACUUGUGGCCUGAAGAGC | 4410 | GCUCUUCAGGCCACAAGUU | Chp | [947-965] 3'UTR |
| 348 | 4054 | UUUAAGCGGGCUGUGAACG | 4411 | CGUUCACAGCCCGCUUAAA | Chp | [213-231] 5'UTR |
| 349 | 4055 | UCCUUGGAGAAAGGUUCUG | 4412 | CAGAACCUUUCUCCAAGGA | Chp | [1114-1132] 3'UTR |
| 350 | 4056 | CUUAGCCAGGUGGAAAUCC | 4413 | GGAUUUCCACCUGGCUAAG | Rat,Ms,GP,Chn,Chp | [595-613] ORF |
| 351 | 4057 | UUCUUUGAAUCCGCGGCUC | 4414 | GAGCCGCGGAUUCAAAGAA | | [150-168] 5'UTR |
| 352 | 4058 | UAAAUCCUUGCUGGCGGAG | 4415 | CUCCGCCAGCAAGGAUUUA | Chp | [97-115] 5'UTR |
| 353 | 4059 | UUUUAAAUCCUUGCUGGCG | 4416 | CGCCAGCAAGGAUUUAAAA | Chp | [94-112] 5'UTR |
| 354 | 4060 | AUAAAGAGGCGUGCCUUCC | 4417 | GGAAGGCACGCCUCUUUAU | Chp | [273-291] 5'UTR |
| 355 | 4061 | UUGAAUAAAGAGGCGUGCC | 4418 | GGCACGCCUCUUUAUUCAA | Chp | [269-287] 5'UTR |
| 356 | 4062 | AUCGACUACAUUCUCGACC | 4419 | GGUCGAGAAUGUAGUCGAU | Chp | [625-643] ORF |
| 357 | 4063 | UUCCUCAUUCUUUGAAUCC | 4420 | GGAUUCAAAGAAUGAGGAA | | [143-161] 5'UTR |

Table A6 CDKN1B - cyclin-dependent kinase inhibitor 1B (p27, Kip1)

| No. | SEQ ID NO. | Sense siRNA | SEQ ID NO. | AntiSense siRNA | Other Sp | Human-17978497 ORF:466-1062 |
|---|---|---|---|---|---|---|
| 1 | 4421 | AAACAAAAGAGCCAACAGA | 4921 | UCUGUUGGCUCUUUUGUUU | | [954-972] ORF |
| 2 | 4422 | CCGGGAGAAAGAUGUCAAA | 4922 | UUUGACAUCUUUCUCCCGG | | [455-473] 5'UTR+ORF |
| 3 | 4423 | CCAUAUGGGGCCACUAAAA | 4923 | UUUUAGUGGCCCAAUAUGG | | [20-38] 5'UTR |
| 4 | 4424 | CAAAACAAAAGAGCCAACA | 4924 | UGUUGGCUCUUUUGUUUUG | | [952-970] ORF |
| 5 | 4425 | GGUGCUUUGGGAGUUUUGAA | 4925 | UUCAAAACUCCCAAGCACC | | [1792-1810] 3'UTR |
| 6 | 4426 | GGUGGACCACGAAGAGUUA | 4926 | UAACUCUUCGUGGUCCACC | | [570-588] ORF |
| 7 | 4427 | AACAAAAGAGCCAACAGAA | 4927 | UUCUGUUGGCUCUUUUGUU | | [955-973] ORF |
| 8 | 4428 | GCAUGUGGCUUUUUUAAAA | 4928 | UUUUAAAAAAGCCACAUGC | | [1658-1676] 3'UTR |
| 9 | 4429 | CCUGUAUAAGCACUGAAAA | 4929 | UUUUCAGUGCUUAUACAGG | | [1181-1199] 3'UTR |
| 10 | 4430 | CCAACAGAACAGAAGAAAA | 4930 | UUUUCUUCUGUUCUGUUGG | Rat,Ms | [965-983] ORF |
| 11 | 4431 | CGCAUUUGGUGGACCCAAA | 4931 | UUUGGGUCCACCAAAUGCG | | [848-866] ORF |
| 12 | 4432 | AAAUGAUCUGCCUCUAAAA | 4932 | UUUUAGAGGCAGAUCAUUU | | [1237-1255] 3'UTR |
| 13 | 4433 | CAUAUGGGCCACUAAAAA | 4933 | UUUUUAGUGGCCCAAUAUG | | [21-39] 5'UTR |
| 14 | 4434 | CGAUUUCAGAAUCACAAA | 4934 | UUUGUGAUUCUGAAAAUCG | | [651-669] ORF |
| 15 | 4435 | CUGUAUAAGCACUGAAAAA | 4935 | UUUUUCAGUGCUUAUACAG | | [1182-1200] 3'UTR |
| 16 | 4436 | AAAACAAAAGAGCCAACAG | 4936 | CUGUUGGCUCUUUUGUUUU | | [953-971] ORF |
| 17 | 4437 | UGGGAGUUUUGAAUGUUAA | 4937 | UUAACAUUCAAAACUCCCA | | [1798-1816] 3'UTR |
| 18 | 4438 | CAUUGCCUGUGUAUGGAAA | 4938 | UUUCCAUACACAGGCAAUG | | [2092-2110] 3'UTR |
| 19 | 4439 | UCAAAACAAAAGAGCCAAC | 4939 | GUUGGCUCUUUUGUUUUGA | | [951-969] ORF |
| 20 | 4440 | GUGUGAAAAAGAUGCCAAU | 4940 | AUUGGCAUCUUUUUCACAC | Ms | [2341-2359] 3'UTR |
| 21 | 4441 | CAUGUUUUGUGCAUUUGUA | 4941 | UACAAAUGCACAAAACAUG | Ms | [2224-2242] 3'UTR |
| 22 | 4442 | AAGUGAAAAUGGUAACUACA | 4942 | UGUAGUAUCCAUUUCACUU | Ms | [2057-2075] 3'UTR |
| 23 | 4443 | CCCGGGAGAAAGAUGUCAA | 4943 | UUGACAUCUUUCUCCCGGG | | [454-472] 5'UTR+ORF |
| 24 | 4444 | CAGAAGACGUCAAACGUAA | 4944 | UUACGUUUGACGUCUUCUG | | [1044-1062] ORF |
| 25 | 4445 | CUGUGUAAACACAGUCAAA | 4945 | UUUGACUGUGUUUACACAG | | [1881-1899] 3'UTR |
| 26 | 4446 | AGUUAAUUACUCAGCAGAA | 4946 | UUCUGCUGAGUAAUUAACU | | [1736-1754] 3'UTR |
| 27 | 4447 | CGUAAACAGCUCGAAUUAA | 4947 | UUAAUUCGAGCUGUUUACG | | [1058-1076] ORF+3'UTR |
| 28 | 4448 | GCCAUAUUGGGCCACUAAA | 4948 | UUUAGUGGCCCAAUAUGGC | | [19-37] 5'UTR |
| 29 | 4449 | GUAGGAUAAGUGAAAUGGA | 4949 | UCCAUUUCACUUAUCCUAC | | [2050-2068] 3'UTR |
| 30 | 4450 | ACUUGUAGGAUAAGUGAAA | 4950 | UUUCACUUAUCCUACAAGU | | [2046-2064] 3'UTR |
| 31 | 4451 | CAAUGCGCAGGAAUAAGGA | 4951 | UCCUUAUUCCUGCGCAUUG | | [904-922] ORF |
| 32 | 4452 | GGAAUUUCGAUUUUCAGAA | 4952 | UUCUGAAAAUCGAAAUUCC | GP,Chn | [644-662] ORF |
| 33 | 4453 | CAUACUGAGCCAAGUAUAA | 4953 | UUAUACUUGGCUCAGUAUG | Ms | [2311-2329] 3'UTR |
| 34 | 4454 | UGCUGUGUUGGGUAGAAUA | 4954 | UAUUCUACCCAACACAGCA | | [2245-2263] 3'UTR |
| 35 | 4455 | CUUGGAGAAGCACUGCAGA | 4955 | UCUGCAGUGCUUCUCCAAG | GP,Chn | [597-615] ORF |
| 36 | 4456 | CGAGGUGCUUGGGAGUUUU | 4956 | AAAACUCCCAAGCACCUCG | | [1789-1807] 3'UTR |
| 37 | 4457 | CUGAAAAACAACAACACAA | 4957 | UUGUGUUGUUGUUUUUCAG | | [1193-1211] 3'UTR |
| 38 | 4458 | CCUUGUUUAUCAGAUACAU | 4958 | AUGUAUCUGAUAAACAAGG | Chn | [1087-1105] 3'UTR |
| 39 | 4459 | AUAAUUCUAAAUCCCUCGA | 4959 | UCGAGGGAUUUAGAAUUAU | | [1900-1918] 3'UTR |
| 40 | 4460 | CCUUUUAUGUAGCACAUAA | 4960 | UUAUGUGCUACAUAAAAGG | | [1330-1348] 3'UTR |
| 41 | 4461 | AGAAGACGUCAAACGUAAA | 4961 | UUUACGUUUGACGUCUUCU | | [1045-1063] ORF+3'UTR |
| 42 | 4462 | AGUGGAAUUUCGAUUUUCA | 4962 | UGAAAAUCGAAAUUCCACU | GP,Chn | [641-659] ORF |
| 43 | 4463 | GCCAAUUAUUGUUACACAU | 4963 | AUGUGUAACAAUAAUUGGC | Ms | [2354-2372] 3'UTR |
| 44 | 4464 | GCUGCAUGUGGCUUUUUUA | 4964 | UAAAAAAGCCACAUGCAGC | | [1655-1673] 3'UTR |
| 45 | 4465 | GUAUAAGCACUGAAAAACA | 4965 | UGUUUUUCAGUGCUUAUAC | | [1184-1202] 3'UTR |
| 46 | 4466 | AGACAAUAUACAAGCCAAA | 4966 | UUUGGCUUGUAUAUUGUCU | Ms | [2201-2219] 3'UTR |
| 47 | 4467 | CUCUGUAAAAACACUGAAA | 4967 | UUUCAGUGUUUUUACAGAG | | [2140-2158] 3'UTR |

FIGURE 4 Continued

| | | | | | | |
|---|---|---|---|---|---|---|
| 48 | 4468 | AGAGAAAAGCACACUUGUA | 4968 | UACAAGUGUGCUUUUCUCU | | [2034-2052] 3'UTR |
| 49 | 4469 | GGAUGUAGCAUUAUGCAAU | 4969 | AUUGCAUAAUGCUACAUCC | | [1261-1279] 3'UTR |
| 50 | 4470 | UCCUGUAUAAGCACUGAAA | 4970 | UUUCAGUGCUUAUACAGGA | GP,Chn | [1180-1198] 3'UTR |
| 51 | 4471 | GCGCAAGUGGAAUUUCGAU | 4971 | AUCGAAAUUCCACUUGCGC | GP,Chn | [636-654] ORF |
| 52 | 4472 | CGCCAUAUUGGGCCACUAA | 4972 | UUAGUGGCCCAAUAUGGCG | | [18-36] 5'UTR |
| 53 | 4473 | GGGAGUUUUGAAUGUUAAG | 4973 | CUUAACAUUCAAAACUCCC | | [1799-1817] 3'UTR |
| 54 | 4474 | AGCGCAAGUGGAAUUUCGA | 4974 | UCGAAAUUCCACUUGCGCU | Rat,Ms,GP,Chn | [635-653] ORF |
| 55 | 4475 | UCAUGUAGAGAAAAGCACA | 4975 | UGUGCUUUUCUCUACAUGA | | [2028-2046] 3'UTR |
| 56 | 4476 | AAAUUUGAACACUGGCUAA | 4976 | UUAGCCAGUGUUCAAAUUU | | [1550-1568] 3'UTR |
| 57 | 4477 | CGGUUUUGUUUUUUUGAGA | 4977 | UCUCAAAAAAACAAAACCG | | [411-429] 5'UTR |
| 58 | 4478 | GAGCCAACAGAACAGAAGA | 4978 | UCUUCUGUUCUGUUGGCUC | | [962-980] ORF |
| 59 | 4479 | AGGAUAAGUGAAAUGGAUA | 4979 | UAUCCAUUUCACUUAUCCU | | [2052-2070] 3'UTR |
| 60 | 4480 | GGGUUUGAAUUGUUUUCUU | 4980 | AAGAAAACAAUUCAAACCC | | [1475-1493] 3'UTR |
| 61 | 4481 | GCUUCAUUGUACUACCUGU | 4981 | ACAGGUAGUACAAUGAAGC | Rat,GP,Chn | [1297-1315] 3'UTR |
| 62 | 4482 | GCAAUUAGGUUUUUCCUUA | 4982 | UAAGGAAAAACCUAAUUGC | Rat,GP,Chn | [1275-1293] 3'UTR |
| 63 | 4483 | AGUGGCAAGAGGUGGAGAA | 4983 | UUCUCCACCUCUUGCCACU | | [689-707] ORF |
| 64 | 4484 | GCAUACUGAGCCAAGUAUA | 4984 | UAUACUUGGCUCAGUAUGC | Ms | [2310-2328] 3'UTR |
| 65 | 4485 | UAGACAAUAUACAAGCCAA | 4985 | UUGGCUUGUAUAUUGUCUA | Ms | [2200-2218] 3'UTR |
| 66 | 4486 | UAUUGGGCCACUAAAAAAA | 4986 | UUUUUUUAGUGGCCCAAUA | | [23-41] 5'UTR |
| 67 | 4487 | AGUUUAUUCUCAUUUGGGA | 4987 | UCCCAAAUGAGAAUAAACU | | [1596-1614] 3'UTR |
| 68 | 4488 | CAUUGUACUACCUGUGUAU | 4988 | AUACACAGGUAGUACAAUG | Rat,GP,Chn | [1301-1319] 3'UTR |
| 69 | 4489 | CCUUAUUUGCUUCAUUGUA | 4989 | UACAAUGAAGCAAAUAAGG | Rat,GP,Chn | [1289-1307] 3'UTR |
| 70 | 4490 | GCUCGCCAGUCCAUUUGAU | 4990 | AUCAAAUGGACUGGCGAGC | | [234-252] 5'UTR |
| 71 | 4491 | AGUGUACCUGUGUACAUAA | 4991 | UUAUGUACACAGGUACACU | | [2121-2139] 3'UTR |
| 72 | 4492 | CCCUCGAUAUUUUUAAAGA | 4992 | UCUUUAAAAAUAUCGAGGG | | [1912-1930] 3'UTR |
| 73 | 4493 | UGACCAUCUGCUUUUAUUA | 4993 | UAAUAAAAGCAGAUGGUCA | | [1821-1839] 3'UTR |
| 74 | 4494 | AUAUUGGGCCACUAAAAAA | 4994 | UUUUUUAGUGGCCCAAUAU | | [22-40] 5'UTR |
| 75 | 4495 | CUGUGUACAUAACUCUGUA | 4995 | UACAGAGUUAUGUACACAG | | [2128-2146] 3'UTR |
| 76 | 4496 | GAAUGUUAAGAAUUGACCA | 4996 | UGGUCAAUUCUUAACAUUC | | [1808-1826] 3'UTR |
| 77 | 4497 | AACACUGGCUAAAGAUAAU | 4997 | AUUAUCUUUAGCCAGUGUU | | [1557-1575] 3'UTR |
| 78 | 4498 | GGUUUUUCCUUAUUUGCUU | 4998 | AAGCAAAUAAGGAAAAACC | Rat,GP,Chn | [1282-1300] 3'UTR |
| 79 | 4499 | GCACUGAAAAACAACAACA | 4999 | UGUUGUUGUUUUUCAGUGC | | [1190-1208] 3'UTR |
| 80 | 4500 | GGCCUCAGAAGACGUCAAA | 5000 | UUUGACGUCUUCUGAGGCC | | [1039-1057] ORF |
| 81 | 4501 | ACAAAGAGCCAACAGAAC | 5001 | GUUCUGUUGGCUCUUUUGU | | [956-974] ORF |
| 82 | 4502 | GGGUAUGAAGAGCUUGCUU | 5002 | AAGCAAGCUCUUCAUACCC | | [1398-1416] 3'UTR |
| 83 | 4503 | AAGAGCCAACAGAACAGAA | 5003 | UUCUGUUCUGUUGGCUCUU | | [960-978] ORF |
| 84 | 4504 | GCAUGUUUUGUGCAUUUGU | 5004 | ACAAAUGCACAAAACAUGC | Ms | [2223-2241] 3'UTR |
| 85 | 4505 | CUCUGUCCAUUUAUCCACA | 5005 | UGUGGAUAAAUGGACAGAG | | [1983-2001] 3'UTR |
| 86 | 4506 | AGAUCUGUAAGUAACUUCA | 5006 | UGAAGUUACUUACAGAUCU | | [1928-1946] 3'UTR |
| 87 | 4507 | GGCUGUGUAAACACAGUCA | 5007 | UGACUGUGUUUACACAGCC | | [1879-1897] 3'UTR |
| 88 | 4508 | GAUUCUUCUACUCAAAACA | 5008 | UGUUUUGAGUAGAAGAAUC | | [940-958] ORF |
| 89 | 4509 | ACUGCAGAGACAUGGAAGA | 5009 | UCUUCCAUGUCUCUGCAGU | GP,Chn | [608-626] ORF |
| 90 | 4510 | CAGUUAAUUACUCAGCAGA | 5010 | UCUGCUGAGUAAUUAACUG | | [1735-1753] 3'UTR |
| 91 | 4511 | AGAUGUAAUGUCCCUUUCA | 5011 | UGAAAGGGACAUUACAUCU | | [1497-1515] 3'UTR |
| 92 | 4512 | GAUGUAGCAUUAUGCAAUU | 5012 | AAUUGCAUAAUGCUACAUC | | [1262-1280] 3'UTR |
| 93 | 4513 | ACUGAAAACAACAACACA | 5013 | UGUGUUGUUGUUUUUCAGU | | [1192-1210] 3'UTR |
| 94 | 4514 | AAACGUAAACAGCUCGAAU | 5014 | AUUCGAGCUGUUUACGUUU | | [1055-1073] ORF+3'UTR |
| 95 | 4515 | ACGAUUCUUCUACUCAAAA | 5015 | UUUUGAGUAGAAGAAUCGU | | [938-956] ORF |
| 96 | 4516 | GCAACCGACGAUUCUUCUA | 5016 | UAGAAGAAUCGUCGGUUGC | | [931-949] ORF |
| 97 | 4517 | AAUGCGCAGGAAUAAGGAA | 5017 | UUCCUUAUUCCUGCGCAUU | | [905-923] ORF |
| 98 | 4518 | UGCCAAUUAUUGUUACACA | 5018 | UGUGUAACAAUAAUUGGCA | Ms | [2353-2371] 3'UTR |
| 99 | 4519 | GAUGCCAAUUAUUGUUACA | 5019 | UGUAACAAUAAUUGGCAUC | Ms | [2351-2369] 3'UTR |
| 100 | 4520 | AAGUGUACCUGUGUACAUA | 5020 | UAUGUACACAGGUACACUU | | [2120-2138] 3'UTR |
| 101 | 4521 | AUUCUAAAUCCCUCGAUAU | 5021 | AUAUCGAGGGAUUUAGAAU | | [1903-1921] 3'UTR |
| 102 | 4522 | GCUGUGUAAACACAGUCAA | 5022 | UUGACUGUGUUUACACAGC | | [1880-1898] 3'UTR |
| 103 | 4523 | CUGCAUGUGGCUUUUUUAA | 5023 | UUAAAAAAGCCACAUGCAG | | [1656-1674] 3'UTR |
| 104 | 4524 | GAGACAGCUGAUACUUCAU | 5024 | AUGAAGUAUCAGCUGUCUC | | [1516-1534] 3'UTR |
| 105 | 4525 | CAUCCUGUAUAAGCACUGA | 5025 | UCAGUGCUUAUACAGGAUG | Rat,Ms,GP,Chn | [1178-1196] 3'UTR |
| 106 | 4526 | CAGAUACAUCACUGCUUGA | 5026 | UCAAGCAGUGAUGUAUCUG | | [1097-1115] 3'UTR |
| 107 | 4527 | GGGUCUGUGUCUUUUGGCU | 5027 | AGCCAAAAGACACAGACCC | | [330-348] 5'UTR |
| 108 | 4528 | CUCAAAACAAAAGAGCCAA | 5028 | UUGGCUCUUUUGUUUUGAG | | [950-968] ORF |
| 109 | 4529 | AGCACUGCAGAGACAUGGA | 5029 | UCCAUGUCUCUGCAGUGCU | GP,Chn | [605-623] ORF |

FIGURE 4 Continued

| | | | | | | | |
|---|---|---|---|---|---|---|---|
| 110 | 4530 | AAUAAUUCUAAAUCCCUCG | 5030 | CGAGGGAUUUAGAAUUAUU | | [1899-1917] 3'UTR |
| 111 | 4531 | CGGGCUGUGUAAACACAGU | 5031 | ACUGUGUUUACACAGCCCG | | [1877-1895] 3'UTR |
| 112 | 4532 | UGGUGAUCUCCCAAGCUAU | 5032 | AUAGCUUGGGAGAUCACCA | | [1619-1637] 3'UTR |
| 113 | 4533 | AGAUCUGGUGAUCUCCCAA | 5033 | UUGGGAGAUCACCAGAUCU | | [1614-1632] 3'UTR |
| 114 | 4534 | GAAGGGUUUGAAUUGUUUU | 5034 | AAAACAAUUCAAACCCUUC | | [1472-1490] 3'UTR |
| 115 | 4535 | CGUUGGAUGUAGCAUUAUG | 5035 | CAUAAUGCUACAUCCAACG | | [1257-1275] 3'UTR |
| 116 | 4536 | AAGCAAGGAAGAUAUACAU | 5036 | AUGUAUAUCUUCCUUGCUU | Ms,GP,Chn | [1118-1136] 3'UTR |
| 117 | 4537 | UGGCCUCAGAAGACGUCAA | 5037 | UUGACGUCUUCUGAGGCCA | | [1038-1056] ORF |
| 118 | 4538 | AUAAGGAAGCGACCUGCAA | 5038 | UUGCAGGUCGCUUCCUUAU | | [916-934] ORF |
| 119 | 4539 | GCUUGCCCGAGUUCUACUA | 5039 | UAGUAGAACUCGGGCAAGC | Rat,Ms | [713-731] ORF |
| 120 | 4540 | CCAUUUGAAGUGUACCUGU | 5040 | ACAGGUACACUUCAAAUGG | | [2113-2131] 3'UTR |
| 121 | 4541 | GCUUACUCUGUCCAUUUAU | 5041 | AUAAAUGGACAGAGUAAGC | | [1978-1996] 3'UTR |
| 122 | 4542 | UUGGGAGUUUUGAAUGUUA | 5042 | UAACAUUCAAAACUCCCAA | | [1797-1815] 3'UTR |
| 123 | 4543 | UGAUUUACAGCAAGUAGAU | 5043 | AUCUACUUGCUGUAAAUCA | | [1417-1435] 3'UTR |
| 124 | 4544 | CUUAAAUGAUCUGCCUCUA | 5044 | UAGAGGCAGAUCAUUUAAG | | [1234-1252] 3'UTR |
| 125 | 4545 | GCCCGAGUUCUACUACAGA | 5045 | UCUGUAGUAGAACUCGGGC | Rat,GP,Chn | [717-735] ORF |
| 126 | 4546 | GUAAAUGCUGUGUUGGGUA | 5046 | UACCCAACACAGCAUUUAC | | [2240-2258] 3'UTR |
| 127 | 4547 | CACUUGUAGGAUAAGUGAA | 5047 | UUCACUUAUCCUACAAGUG | | [2045-2063] 3'UTR |
| 128 | 4548 | UGGAUGUAGCAUAAUGCAA | 5048 | UUGCAUAAUGCUACAUCCA | | [1260-1278] 3'UTR |
| 129 | 4549 | UGGAAUUUCGAUUUUCAGA | 5049 | UCUGAAAAUCGAAAUUCCA | GP,Chn | [643-661] ORF |
| 130 | 4550 | UGUGUGAAAAGAUGCCAA | 5050 | UUGGCAUCUUUUUCACACA | Ms | [2340-2358] 3'UTR |
| 131 | 4551 | AAUGCUGUGUUGGGUAGAA | 5051 | UUCUACCCAACACAGCAUU | | [2243-2261] 3'UTR |
| 132 | 4552 | GUAUGGAAAAACCAUUUGA | 5052 | UCAAAUGGUUUUUCCAUUAC | | [2102-2120] 3'UTR |
| 133 | 4553 | CUGUGUAUGGAAAAACCAU | 5053 | AUGGUUUUUCCAUACACAG | | [2098-2116] 3'UTR |
| 134 | 4554 | UCAUUGCCUGUGUAUGGAA | 5054 | UUCCAUACACAGGCAAUGA | | [2091-2109] 3'UTR |
| 135 | 4555 | CUUGUAGGAUAAGUGAAAU | 5055 | AUUUCACUUAUCCUACAAG | | [2047-2065] 3'UTR |
| 136 | 4556 | GUUCAUGUAGAGAAAAGCA | 5056 | UGCUUUUCUCUACAUGAAC | | [2026-2044] 3'UTR |
| 137 | 4557 | CUAAAUCCCUCGAUAUUUU | 5057 | AAAAAUAUCGAGGGAUUUAG | | [1906-1924] 3'UTR |
| 138 | 4558 | GUGUAAACACAGUCAAAAU | 5058 | AUUUUGACUGUGUUUACAC | | [1883-1901] 3'UTR |
| 139 | 4559 | GCUUGGGAGUUUUGAAUGU | 5059 | ACAUUCAAAACUCCCAAGC | | [1795-1813] 3'UTR |
| 140 | 4560 | GUGCUUGGGAGUUUUGAAU | 5060 | AUUCAAAACUCCCAAGCAC | | [1793-1811] 3'UTR |
| 141 | 4561 | AGGUGCUUGGGAGUUUUGA | 5061 | UCAAAACUCCCAAGCACCU | | [1791-1809] 3'UTR |
| 142 | 4562 | CGCUUUGUUUUGUUCGGUU | 5062 | AACCGAACAAAACAAAGCG | | [397-415] 5'UTR |
| 143 | 4563 | AUGAAGCAAGGAAGAUAUA | 5063 | UAUAUCUUCCUUGCUUCAU | Ms,GP,Chn | [1115-1133] 3'UTR |
| 144 | 4564 | AAAAGAGCCAACAGAACAG | 5064 | CUGUUCUGUUGGCUCUUUU | | [958-976] ORF |
| 145 | 4565 | GCAGGAAUAAGGAAGCGAC | 5065 | GUCGCUUCCUUAUUCCUGC | | [910-928] ORF |
| 146 | 4566 | GUGAAAAAGAUGCCAAUUA | 5066 | UAAUUGGCAUCUUUUUCAC | Ms | [2343-2361] 3'UTR |
| 147 | 4567 | UUCACUUCGGGCUGUGUAA | 5067 | UUACACAGCCCGAAGUGAA | | [1870-1888] 3'UTR |
| 148 | 4568 | GGAGUUUUGAAUGUUAAGA | 5068 | UCUUAACAUUCAAAACUCC | | [1800-1818] 3'UTR |
| 149 | 4569 | GAUUUACAGCAAGUAGAUA | 5069 | UAUCUACUUGCUGUAAAUC | | [1418-1436] 3'UTR |
| 150 | 4570 | AAGCACUGAAAAACAACAA | 5070 | UUGUUGUUUUUCAGUGCUU | | [1188-1206] 3'UTR |
| 151 | 4571 | CAUUUGGUGGACCCAAAGA | 5071 | UCUUUGGGUCCACCAAAUG | | [850-868] ORF |
| 152 | 4572 | AUUGCCUGUGUAUGGAAAA | 5072 | UUUUCCAUACACAGGCAAU | | [2093-2111] 3'UTR |
| 153 | 4573 | GUGGACCACGAAGAGUUAA | 5073 | UUAACUCUUCGUGGUCCAC | | [571-589] ORF |
| 154 | 4574 | AAUUGACCAUCUGCUUUUA | 5074 | UAAAAGCAGAUGGUCAAUU | | [1818-1836] 3'UTR |
| 155 | 4575 | AGUCUCUCUUAAAGUUGGA | 5075 | UCCAACUUUAAGAGAGACU | | [1710-1728] 3'UTR |
| 156 | 4576 | ACAGCUGAUACUUCAUUUA | 5076 | UAAAUGAAGUAUCAGCUGU | | [1519-1537] 3'UTR |
| 157 | 4577 | UCAUUGUACUACCUGUGUA | 5077 | UACACAGGUAGUACAAUGA | Rat,GP,Chn | [1300-1318] 3'UTR |
| 158 | 4578 | CAUGGAAUGGACAUCCUGU | 5078 | ACAGGAUGUCCAUUCCAUG | GP,Chn | [1167-1185] 3'UTR |
| 159 | 4579 | CUUGAUGAAGCAAGGAAGA | 5079 | UCUUCCUUGCUUCAUCAAG | Chn | [1111-1129] 3'UTR |
| 160 | 4580 | GCUCGAAUUAAGAAUAUGU | 5080 | ACAUAUUCUUAAUUCGAGC | | [1066-1084] 3'UTR |
| 161 | 4581 | AAGAAGCCUGGCCUCAGAA | 5081 | UUCUGAGGCCAGGCUUCUU | | [1030-1048] ORF |
| 162 | 4582 | UGGCUAUGCUUAAAAGGUU | 5082 | AACCUUUUAAGCAUAGCCA | | [2291-2309] 3'UTR |
| 163 | 4583 | CCUGUGUAUGGAAAAACCA | 5083 | UGGUUUUUCCAUACACAGG | | [2097-2115] 3'UTR |
| 164 | 4584 | AGUGAAUGGAUACUACAU | 5084 | AUGUAGUAUCCAUUCACU | Ms | [2058-2076] 3'UTR |
| 165 | 4585 | AGAUGUCAAACGUGCGAGU | 5085 | ACUCGCACGUUUGACAUCU | | [464-482] 5'UTR+ORF |
| 166 | 4586 | AAAAGCAACAGAAACCUAU | 5086 | AUAGGUUUCUGUUGCUUUU | | [1675-1693] 3'UTR |
| 167 | 4587 | UGGCUAAAGAUAAUUGCUA | 5087 | UAGCAAUUAUCUUUAGCCA | | [1562-1580] 3'UTR |
| 168 | 4588 | CAUGAAGAGAAGCAAUUUU | 5088 | AAAAUUGCUUCUCUUCAUG | GP | [1450-1468] 3'UTR |
| 169 | 4589 | GCUUGAUGAAGCAAGGAAG | 5089 | CUUCCUUGCUUCAUCAAGC | Chn | [1110-1128] 3'UTR |
| 170 | 4590 | AGAAGAAAAUGUUUCAGAC | 5090 | GUCUGAAACAUUUUCUUCU | Rat,Ms,GP,Chn | [975-993] ORF |
| 171 | 4591 | GCCAACAGAACAGAAGAAA | 5091 | UUUCUUCUGUUCUGUUGGC | Rat,Ms | [964-982] ORF |

FIGURE 4 Continued

| | | | | | | |
|---|---|---|---|---|---|---|
| 172 | 4592 | AGCCAACAGAACAGAAGAA | 5092 | UUCUUCUGUUCUGUUGGCU | | [963-981] ORF |
| 173 | 4593 | CAAAGACUGAUCCGUCGGA | 5093 | UCCGACGGAUCAGUCUUUG | | [863-881] ORF |
| 174 | 4594 | CUGAGGACACGCAUUUGGU | 5094 | ACCAAAUGCGUGUCCUCAG | | [839-857] ORF |
| 175 | 4595 | GGUUGCAUACUGAGCCAAG | 5095 | CUUGGCUCAGUAUGCAACC | Ms | [2306-2324] 3'UTR |
| 176 | 4596 | AGUUAACCCGGGACUUGGA | 5096 | UCCAAGUCCCGGGUUAACU | GP,Chn | [584-602] ORF |
| 177 | 4597 | GGAUAAGUGAAAUGGAUAC | 5097 | GUAUCCAUUUCACUUAUCC | | [2053-2071] 3'UTR |
| 178 | 4598 | AAGGUUCAUGUAGAGAAAA | 5098 | UUUUCUCUACAUGAACCUU | | [2023-2041] 3'UTR |
| 179 | 4599 | GCAAAAAUCCGAGGUGCUU | 5099 | AAGCACCUCGGAUUUUUGC | | [1780-1798] 3'UTR |
| 180 | 4600 | AAAAAGCAACAGAAACCUA | 5100 | UAGGUUUCUGUUGCUUUUU | | [1674-1692] 3'UTR |
| 181 | 4601 | CAUUUGGGAGAUCUGGUGA | 5101 | UCACCAGAUCUCCCAAAUG | | [1606-1624] 3'UTR |
| 182 | 4602 | UUGACUUGCAUGAAGAGAA | 5102 | UUCUCUUCAUGCAAGUCAA | | [1442-1460] 3'UTR |
| 183 | 4603 | UGUUUUUUUGAGAGUGCGA | 5103 | UCGCACUCUCAAAAAACA | | [417-435] 5'UTR |
| 184 | 4604 | GCAUUAUGCAAUUAGGUUU | 5104 | AAACCUAAUUGCAUAAUGC | | [1268-1286] 3'UTR |
| 185 | 4605 | CCUGCAACCGACGAUUCUU | 5105 | AAGAAUCGUCGGUUGCAGG | | [928-946] ORF |
| 186 | 4606 | UGGUGGACCCAAAGACUGA | 5106 | UCAGUCUUUGGGUCCACCA | | [854-872] ORF |
| 187 | 4607 | GUGGAAUUCGAUUUUCAG | 5107 | CUGAAAAUCGAAAUUCCAC | GP,Chn | [642-660] ORF |
| 188 | 4608 | GGCUAUGCUUAAAAGGUUG | 5108 | CAACCUUUUAAGCAUAGCC | | [2292-2310] 3'UTR |
| 189 | 4609 | AAGCCAAAGUGGCAUGUUU | 5109 | AAACAUGCCACUUUGGCUU | Ms | [2212-2230] 3'UTR |
| 190 | 4610 | UUGCCUGUGUAUGGAAAAA | 5110 | UUUUUCCAUACACAGGCAA | | [2094-2112] 3'UTR |
| 191 | 4611 | UUCUAAAUCCCUCGAUAUU | 5111 | AAUAUCGAGGGAUUUAGAA | | [1904-1922] 3'UTR |
| 192 | 4612 | CCAGUUAAUUACUCAGCAG | 5112 | CUGCUGAGUAAUUAACUGG | | [1734-1752] 3'UTR |
| 193 | 4613 | AUCUCCCAAGCUAUCUAAA | 5113 | UUUAGAUAGCUUGGGAGAU | | [1624-1642] 3'UTR |
| 194 | 4614 | GCGUUGGAUGUAGCAUUAU | 5114 | AUAAUGCUACAUCCAACGC | | [1256-1274] 3'UTR |
| 195 | 4615 | ACAACAACACAAUAACACU | 5115 | AGUGUUAUUGUGUUGUUGU | | [1200-1218] 3'UTR |
| 196 | 4616 | UAAGCACUGAAAAACAACA | 5116 | UGUUGUUUUUCAGUGCUUA | | [1187-1205] 3'UTR |
| 197 | 4617 | UAUCGCUGACUUCAUGGAA | 5117 | UUCCAUGAAGUCAGCGAUA | | [1155-1173] 3'UTR |
| 198 | 4618 | AGAAAAUGUUUCAGACGGU | 5118 | ACCGUCUGAAACAUUUUCU | Rat,Ms,GP,Chn | [978-996] ORF |
| 199 | 4619 | ACUCAAAACAAAAGAGCCA | 5119 | UGGCUCUUUUGUUUUGAGU | | [949-967] ORF |
| 200 | 4620 | CGAUUCUUCUACUCAAAAC | 5120 | GUUUUGAGUAGAAGAAUCG | | [939-957] ORF |
| 201 | 4621 | CUAACUCUGAGGACACGCA | 5121 | UGCGUGUCCUCAGAGUUAG | | [833-851] ORF |
| 202 | 4622 | GACUUGGAGAAGCACUGCA | 5122 | UGCAGUGCUUCUCCAAGUC | GP,Chn | [595-613] ORF |
| 203 | 4623 | UAGAGAAAAGCACACUUGU | 5123 | ACAAGUGCUUUUCUCUA | | [2033-2051] 3'UTR |
| 204 | 4624 | GAGAUCUGGUGAUCUCCCA | 5124 | UGGGAGAUCACCAGAUCUC | | [1613-1631] 3'UTR |
| 205 | 4625 | GCUUUGUUUUGUUCGGUUU | 5125 | AAACCGAACAAAACAAAGC | | [398-416] 5'UTR |
| 206 | 4626 | UGGACAUCCUGUAUAAGCA | 5126 | UGCUUAUACAGGAUGUCCA | Rat,Ms,GP,Chn | [1174-1192] 3'UTR |
| 207 | 4627 | AUGGAAUGGACAUCCUGUA | 5127 | UACAGGAUGUCCAUUCCAU | GP,Chn | [1168-1186] 3'UTR |
| 208 | 4628 | CUGUGUCUUUUGGCUCCGA | 5128 | UCGGAGCCAAAAGACACAG | | [334-352] 5'UTR |
| 209 | 4629 | CAAACGUAAACAGCUCGAA | 5129 | UUCGAGCUGUUUACGUUUG | | [1054-1072] ORF+3'UTR |
| 210 | 4630 | GAAAAUGUUUCAGACGGUU | 5130 | AACCGUCUGAAACAUUUUC | Rat,Ms,GP,Chn | [979-997] ORF |
| 211 | 4631 | CAGAAGAAAAUGUUUCAGA | 5131 | UCUGAAACAUUUUCUUCUG | Rat,Ms,GP,Chn | [974-992] ORF |
| 212 | 4632 | CCGACGAUUCUUCUACUCA | 5132 | UGAGUAGAAGAAUCGUCGG | | [935-953] ORF |
| 213 | 4633 | GGUGGACCCAAAGACUGAU | 5133 | AUCAGUCUUUGGGUCCACC | | [855-873] ORF |
| 214 | 4634 | GUUGCAUACUGAGCCAAGU | 5134 | ACUUGGCUCAGUAUGCAAC | Ms | [2307-2325] 3'UTR |
| 215 | 4635 | UGGAGAAGCACUGCAGAGA | 5135 | UCUCUGCAGUGCUUCUCCA | GP,Chn | [599-617] ORF |
| 216 | 4636 | CCAUUUAUCCACAGGAAAG | 5136 | CUUUCCUGUGGAUAAAUGG | | [1989-2007] 3'UTR |
| 217 | 4637 | UCCAUUUAUCCACAGGAAA | 5137 | UUUCCUGUGGAUAAAUGGA | | [1988-2006] 3'UTR |
| 218 | 4638 | UCAGCAGAAUGGUGAUCAC | 5138 | GUGAUCACCAUUCUGCUGA | | [1746-1764] 3'UTR |
| 219 | 4639 | GUAGCAUUAUGCAAUUAGG | 5139 | CCUAAUUGCAUAAUGCUAC | | [1265-1283] 3'UTR |
| 220 | 4640 | CACUAAAAUUUUAGGCACU | 5140 | AGUGCCUAAAAUUUUAGUG | Ms,GP,Chn | [1215-1233] 3'UTR |
| 221 | 4641 | GGACAUCCUGUAUAAGCAC | 5141 | GUGCUUAUACAGGAUGUCC | Rat,Ms,GP,Chn | [1175-1193] 3'UTR |
| 222 | 4642 | AAGACUGAUCCGUCGGACA | 5142 | UGUCCGACGGAUCAGUCUU | | [865-883] ORF |
| 223 | 4643 | UCGAUUUCAGAAUCACAA | 5143 | UUGUGAUUCGAAAAUCGA | GP,Chn | [650-668] ORF |
| 224 | 4644 | CGCAAGUGGAAUUUCGAUU | 5144 | AAUCGAAAUUCCACUUGCG | GP,Chn | [637-655] ORF |
| 225 | 4645 | AAGGAAGGUUCAUGUAGAG | 5145 | CUCUACAUGAACCUUCCUU | | [2019-2037] 3'UTR |
| 226 | 4646 | UAUCCACAGGAAAGUGUUA | 5146 | UAACACUUUCCUGUGGAUA | | [1994-2012] 3'UTR |
| 227 | 4647 | ACUUCGGGCUGUGUAAACA | 5147 | UGUUUACACAGCCCGAAGU | | [1873-1891] 3'UTR |
| 228 | 4648 | UUUUUUUGAGAGUGCGAGA | 5148 | UCUCGCACUCUCAAAAAAA | | [419-437] 5'UTR |
| 229 | 4649 | AAAAGCGUUGGAUGUAGCA | 5149 | UGCUACAUCCAACGCUUUU | | [1252-1270] 3'UTR |
| 230 | 4650 | AAGGUUGCAUACUGAGCCA | 5150 | UGGCUCAGUAUGCAACCUU | Ms | [2304-2322] 3'UTR |
| 231 | 4651 | UGUUGGGUAGAAUAGGUUU | 5151 | AAACCUAUUCUACCCAACA | | [2250-2268] 3'UTR |
| 232 | 4652 | UGUGUUGGGUAGAAUAGGU | 5152 | ACCUAUUCUACCCAACACA | | [2248-2266] 3'UTR |
| 233 | 4653 | ACGAAGAGUUAACCCGGGA | 5153 | UCCCGGGUUAACUCUUCGU | GP,Chn | [578-596] ORF |

FIGURE 4 Continued

| | | | | | | | |
|---|---|---|---|---|---|---|---|
| 234 | 4654 | ACACUUGUAGGAUAAGUGA | 5154 | UCACUUAUCCUACAAGUGU | | [2044-2062] 3'UTR |
| 235 | 4655 | UGUGUAAACACAGUCAAAA | 5155 | UUUUGACUGUGUUUACACA | | [1882-1900] 3'UTR |
| 236 | 4656 | CUCUCUUAAAGUUGGAAUU | 5156 | AAUUCCAACUUUAAGAGAG | | [1713-1731] 3'UTR |
| 237 | 4657 | CAACAGAAACCUAUCCUCA | 5157 | UGAGGAUAGGUUUCUGUUG | | [1680-1698] 3'UTR |
| 238 | 4658 | AGUUUGUUAGAUAGCUGCA | 5158 | UGCAGCUAUCUAACAAACU | | [1642-1660] 3'UTR |
| 239 | 4659 | AAAAUUUGAACACUGGCUA | 5159 | UAGCCAGUGUUCAAAUUUU | | [1549-1567] 3'UTR |
| 240 | 4660 | AAGAGCUUGCUUUGAUUUA | 5160 | UAAAUCAAAGCAAGCUCUU | | [1405-1423] 3'UTR |
| 241 | 4661 | AAGCGUUGGAUGUAGCAUU | 5161 | AAUGCUACAUCCAACGCUU | | [1254-1272] 3'UTR |
| 242 | 4662 | GUUUCCUUGUUUAUCAGAU | 5162 | AUCUGAUAAACAAGGAAAC | Chn | [1083-1101] 3'UTR |
| 243 | 4663 | GCAUUUGGUGGACCCAAAG | 5163 | CUUUGGGUCCACCAAAUGC | | [849-867] ORF |
| 244 | 4664 | CACUGCAGAGACAUGGAAG | 5164 | CUUCCAUGUCUCUGCAGUG | GP,Chn | [607-625] ORF |
| 245 | 4665 | GAAGCACUGCAGAGACAUG | 5165 | CAUGUCUCUGCAGUGCUUC | GP,Chn | [603-621] ORF |
| 246 | 4666 | GUGCAUUUGUAAAUGCUGU | 5166 | ACAGCAUUUACAAAUGCAC | Ms | [2232-2250] 3'UTR |
| 247 | 4667 | GAAGUGUACCUGUGUACAU | 5167 | AUGUACACAGGUACACUUC | | [2119-2137] 3'UTR |
| 248 | 4668 | UUUGAAGUGUACCUGUGUA | 5168 | UACACAGGUACACUUCAAA | | [2116-2134] 3'UTR |
| 249 | 4669 | UAAUUCUAAAUCCCUCGAU | 5169 | AUCGAGGGAUUUAGAAUUA | | [1901-1919] 3'UTR |
| 250 | 4670 | UGUUAAGAAUUGACCAUCU | 5170 | AGAUGGUCAAUUCUUAACA | | [1811-1829] 3'UTR |
| 251 | 4671 | CAGAAUGGUGAUCACUCCA | 5171 | UGGAGUGAUCACCAUUCUG | | [1750-1768] 3'UTR |
| 252 | 4672 | AAUUUGAACACUGGCUAAA | 5172 | UUUUAGCCAGUGUUCAAAUU | | [1551-1569] 3'UTR |
| 253 | 4673 | CCCUUUCAGAGACAGCUGA | 5173 | UCAGCUGUCUCUGAAAGGG | | [1508-1526] 3'UTR |
| 254 | 4674 | AUGUAAUGUCCCUUUCAGA | 5174 | UCUGAAAGGGACAUUACAU | | [1499-1517] 3'UTR |
| 255 | 4675 | UGACUUCAUGGAAUGGACA | 5175 | UGUCCAUUCCAUGAAGUCA | | [1161-1179] 3'UTR |
| 256 | 4676 | AUCGCUGACUUCAUGGAAU | 5176 | AUUCCAUGAAGUCAGCGAU | | [1156-1174] 3'UTR |
| 257 | 4677 | GCUGUGUUGGGUAGAAUAG | 5177 | CUAUUCUACCCAACACAGC | | [2246-2264] 3'UTR |
| 258 | 4678 | GCACACUUGUAGGAUAAGU | 5178 | ACUUAUCCUACAAGUGUGC | | [2042-2060] 3'UTR |
| 259 | 4679 | UGUAGAGAAAAGCACACUU | 5179 | AAGUGUGCUUUUCUCUACA | | [2031-2049] 3'UTR |
| 260 | 4680 | AAGAAUUGACCAUCUGCUU | 5180 | AAGCAGAUGGUCAAUUCUU | | [1815-1833] 3'UTR |
| 261 | 4681 | GUCUCUCUUAAAGUUGGAA | 5181 | UUCCAACUUUAAGAGAGAC | | [1711-1729] 3'UTR |
| 262 | 4682 | CUUGCAUGAAGAGAAGCAA | 5182 | UUGCUUCUCUUCAUGCAAG | GP | [1446-1464] 3'UTR |
| 263 | 4683 | CUCUAAAAGCGUUGGAUGU | 5183 | ACAUCCAACGCUUUUAGAG | | [1248-1266] 3'UTR |
| 264 | 4684 | CAAAUGCCGGUUCUGUGGA | 5184 | UCCACAGAACCGGCAUUUG | | [1001-1019] ORF |
| 265 | 4685 | UAACUCUGAGGACACGCAU | 5185 | AUGCGUGUCCUCAGAGUUA | | [834-852] ORF |
| 266 | 4686 | CUAGAGGGCAAGUACGAGU | 5186 | ACUCGUACUUGCCCUCUAG | | [673-691] ORF |
| 267 | 4687 | UCGCCAGUCCAUUUGAUCA | 5187 | UGAUCAAAUGGACUGGCGA | | [236-254] 5'UTR |
| 268 | 4688 | CAGCGCAAGUGGAAUUUCG | 5188 | CGAAAUUCCACUUGCGCUG | Rat,Ms,GP,Chn | [634-652] ORF |
| 269 | 4689 | GUGUACAUAAACUCUGUAAA | 5189 | UUUACAGAGUUAUGUACAC | | [2130-2148] 3'UTR |
| 270 | 4690 | GUGUAUGGAAAAACCAUUU | 5190 | AAAUGGUUUUUCCAUACAC | | [2100-2118] 3'UTR |
| 271 | 4691 | AACCGACGAUUCUUCUACU | 5191 | AGUAGAAGAAUCGUCGGUU | | [933-951] ORF |
| 272 | 4692 | AGUACGAGUGGCAAGAGGU | 5192 | ACCUCUUGCCACUCGUACU | | [683-701] ORF |
| 273 | 4693 | CUGAGCCAAGUAUAAUUUU | 5193 | AAAAUUAUACUUGGCUCAG | Ms | [2315-2333] 3'UTR |
| 274 | 4694 | UGGCAUGUUUUGUGCAUUU | 5194 | AAAUGCACAAAACAUGCCA | Ms | [2221-2239] 3'UTR |
| 275 | 4695 | AGUGGCAUGUUUUGUGCAU | 5195 | AUGCACAAAACAUGCCACU | Ms | [2219-2237] 3'UTR |
| 276 | 4696 | ACUCUGUAAAAACACUGAA | 5196 | UUCAGUGUUUUUACAGAGU | | [2139-2157] 3'UTR |
| 277 | 4697 | GGAUACUACAUCUUUAAAC | 5197 | GUUUAAAGAUGUAGUAUCC | Ms | [2066-2084] 3'UTR |
| 278 | 4698 | UGGUGAUCACUCCAGGUAG | 5198 | CUACCUGGAGUGAUCACCA | | [1755-1773] 3'UTR |
| 279 | 4699 | AAAGAUGUCAAACGUGCGA | 5199 | UCGCACGUUUGACAUCUUU | | [462-480] 5'UTR+ORF |
| 280 | 4700 | GGGAGAAAGAUGUCAAACG | 5200 | CGUUUGACAUCUUUCUCCC | | [457-475] 5'UTR+ORF |
| 281 | 4701 | GUUUGUUAGAUAGCUGCAU | 5201 | AUGCAGCUAUCUAACAAAC | | [1643-1661] 3'UTR |
| 282 | 4702 | CUGGCUAAAGAUAAUUGCU | 5202 | AGCAAUUAUCUUUAGCCAG | | [1561-1579] 3'UTR |
| 283 | 4703 | CCUCUAAAAGCGUUGGAUG | 5203 | CAUCCAACGCUUUUAGAGG | | [1247-1265] 3'UTR |
| 284 | 4704 | CUGACUUCAUGGAAUGGAC | 5204 | GUCCAUUCCAUGAAGUCAG | | [1160-1178] 3'UTR |
| 285 | 4705 | UACAUAUCGCUGACUUCAU | 5205 | AUGAAGUCAGCGAUAUGUA | | [1151-1169] 3'UTR |
| 286 | 4706 | ACGCAUUUGGUGGACCCAA | 5206 | UUGGGUCCACCAAAUGCGU | | [847-865] ORF |
| 287 | 4707 | UAACCCGGGACUUGGAGAA | 5207 | UUCUCCAAGUCCCGGGUUA | Rat,Ms,GP,Chn | [587-605] ORF |
| 288 | 4708 | GAAAGAUGUCAAACGUGCG | 5208 | CGCACGUUUGACAUCUUUC | | [461-479] 5'UTR+ORF |
| 289 | 4709 | AGACCCGGGAGAAAGAUGU | 5209 | ACAUCUUUCUCCCGGGUCU | | [451-469] 5'UTR+ORF |
| 290 | 4710 | CUUUCAGAGACAGCUGAUA | 5210 | UAUCAGCUGUCUCUGAAAG | | [1510-1528] 3'UTR |
| 291 | 4711 | UUGAUUUACAGCAAGUAGA | 5211 | UCUACUUGCUGUAAAUCAA | | [1416-1434] 3'UTR |
| 292 | 4712 | UUUAGGCACUCUUAAAUGA | 5212 | UCAUUUAAGAGUGCCUAAA | GP,Chn | [1224-1242] 3'UTR |
| 293 | 4713 | AUCCUGUAUAAGCACUGAA | 5213 | UUCAGUGCUUAUACAGGAU | GP,Chn | [1179-1197] 3'UTR |
| 294 | 4714 | AAUAAGGAAGCGACCUGCA | 5214 | UGCAGGUCGCUUCCUUAUU | | [915-933] ORF |
| 295 | 4715 | AGGACACGCAUUUGGUGGA | 5215 | UCCACCAAAUGCGUGUCCU | | [842-860] ORF |

FIGURE 4 Continued

| | | | | | | |
|---|---|---|---|---|---|---|
| 296 | 4716 | AACUCUGAGGACACGCAUU | 5216 | AAUGCGUGUCCUCAGAGUU | | [835-853] ORF |
| 297 | 4717 | AUAUGGCUAUGCUUAAAAG | 5217 | CUUUUAAGCAUAGCCAUAU | | [2288-2306] 3'UTR |
| 298 | 4718 | GUGUUGGGUAGAAUAGGUU | 5218 | AACCUAUUCUACCCAACAC | | [2249-2267] 3'UTR |
| 299 | 4719 | AACUCUGUAAAAACACUGA | 5219 | UCAGUGUUUUUACAGAGUU | | [2138-2156] 3'UTR |
| 300 | 4720 | AGGUUCAUGUAGAGAAAAG | 5220 | CUUUUCUCUACAUGAACCU | | [2024-2042] 3'UTR |
| 301 | 4721 | GAAUGGUGAUCACUCCAGG | 5221 | CCUGGAGUGAUCACCAUUC | | [1752-1770] 3'UTR |
| 302 | 4722 | CAGUCUCUCUUAAAGUUGG | 5222 | CCAACUUUAAGAGAGACUG | | [1709-1727] 3'UTR |
| 303 | 4723 | UGAAGAGAAGCAAUUUUGG | 5223 | CCAAAAUUGCUUCUCUUCA | | [1452-1470] 3'UTR |
| 304 | 4724 | CAGAACAGAAGAAAAUGUU | 5224 | AACAUUUUCUUCUGUUCUG | Rat,Ms,GP,Chn | [969-987] ORF |
| 305 | 4725 | CCAUUUGAUCAGCGGAGAC | 5225 | GUCUCCGCUGAUCAAAUGG | | [244-262] 5'UTR |
| 306 | 4726 | AUGCUGUGUUGGGUAGAAU | 5226 | AUUCUACCCAACACAGCAU | | [2244-2262] 3'UTR |
| 307 | 4727 | GGCAAAAAUCCGAGGUGCU | 5227 | AGCACCUCGGAUUUUUGCC | | [1779-1797] 3'UTR |
| 308 | 4728 | CUCAUUUGGGAGAUCUGGU | 5228 | ACCAGAUCUCCCAAAUGAG | | [1604-1622] 3'UTR |
| 309 | 4729 | CACAAAAAUUUGAACACUG | 5229 | CAGUGUUCAAAUUUUUGUG | | [1545-1563] 3'UTR |
| 310 | 4730 | GCUUUGAUUUACAGCAAGU | 5230 | ACUUGCUGUAAAUCAAAGC | | [1413-1431] 3'UTR |
| 311 | 4731 | ACUCUUAAAUGAUCUGCCU | 5231 | AGGCAGAUCAUUUAAGAGU | | [1231-1249] 3'UTR |
| 312 | 4732 | AGAGCCAACAGAACAGAAG | 5232 | CUUCUGUUCUGUUGGCUCU | | [961-979] ORF |
| 313 | 4733 | AAAGAGCCAACAGAACAGA | 5233 | UCUGUUCUGUUGGCUCUUU | | [959-977] ORF |
| 314 | 4734 | AGGUUGCAUACUGAGCCAA | 5234 | UUGGCUCAGUAUGCAACCU | Ms | [2305-2323] 3'UTR |
| 315 | 4735 | GCUUAAAAGGUUGCAUACU | 5235 | AGUAUGCAACCUUUUAAGC | Ms | [2298-2316] 3'UTR |
| 316 | 4736 | GUUGGGUAGAAUAGGUUUU | 5236 | AAAACCUAUUCUACCCAAC | | [2251-2269] 3'UTR |
| 317 | 4737 | AGUAUUUCAUUGCCUGUGU | 5237 | ACACAGGCAAUGAAAUACU | | [2085-2103] 3'UTR |
| 318 | 4738 | GGUUCAUGUAGAGAAAAGC | 5238 | GCUUUUCUCUACAUGAACC | | [2025-2043] 3'UTR |
| 319 | 4739 | CAUUUAUCCACAGGAAAGU | 5239 | ACUUUCCUGUGGAUAAAUG | | [1990-2008] 3'UTR |
| 320 | 4740 | UACUCUGUCCAUUUAUCCA | 5240 | UGGAUAAAUGGACAGAGUA | | [1981-1999] 3'UTR |
| 321 | 4741 | AUCUGUAAGUAACUUCACA | 5241 | UGUGAAGUUACUUACAGAU | | [1930-1948] 3'UTR |
| 322 | 4742 | AAUGGUGAUCACUCCAGGU | 5242 | ACCUGGAGUGAUCACCAUU | | [1753-1771] 3'UTR |
| 323 | 4743 | CAGCAGAAUGGUGAUCACU | 5243 | AGUGAUCACCAUUCUGCUG | | [1747-1765] 3'UTR |
| 324 | 4744 | ACCAGUUAAUUACUCAGCA | 5244 | UGCUGAGUAAUUAACUGGU | | [1733-1751] 3'UTR |
| 325 | 4745 | CGGGAGAAAGAUGUCAAAC | 5245 | GUUUGACAUCUUUCUCCCG | | [456-474] 5'UTR+ORF |
| 326 | 4746 | UGAUCUCCCAAGCUAUCUA | 5246 | UAGAUAGCUUGGGAGAUCA | | [1622-1640] 3'UTR |
| 327 | 4747 | GCUGACUUCAUGGAAUGGA | 5247 | UCCAUUCCAUGAAGUCAGC | | [1159-1177] 3'UTR |
| 328 | 4748 | GGCGCUUUGUUUUGUUCGG | 5248 | CCGAACAAAACAAAGCGCC | | [395-413] 5'UTR |
| 329 | 4749 | AGACGUCAAACGUAAACAG | 5249 | CUGUUUACGUUUGACGUCU | Chn | [1048-1066] ORF+3'UTR |
| 330 | 4750 | AGAUGCCAAUUAUUGUUAC | 5250 | GUAACAAUAAUUGGCAUCU | Ms | [2350-2368] 3'UTR |
| 331 | 4751 | AAAUGCUGUGUUGGGUAGA | 5251 | UCUACCCAACACAGCAUUU | | [2242-2260] 3'UTR |
| 332 | 4752 | GUGGCAUGUUUUGUGCAUU | 5252 | AAUGCACAAAACAUGCCAC | Ms | [2220-2238] 3'UTR |
| 333 | 4753 | CCAAAGUGGCAUGUUUUGU | 5253 | ACAAAACAUGCCACUUUGG | Ms | [2215-2233] 3'UTR |
| 334 | 4754 | CAUUUGAAGUGUACCUGUG | 5254 | CACAGGUACACUUCAAAUG | | [2114-2132] 3'UTR |
| 335 | 4755 | GAAAAACCAUUUGAAGUGU | 5255 | ACACUUCAAAUGGUUUUUC | | [2107-2125] 3'UTR |
| 336 | 4756 | AGGAAGGUUCAUGUAGAGA | 5256 | UCUCUACAUGAACCUUCCU | | [2020-2038] 3'UTR |
| 337 | 4757 | UCACUUCGGGCUGUGUAAA | 5257 | UUUACACAGCCCGAAGUGA | | [1871-1889] 3'UTR |
| 338 | 4758 | GAGAAAGAUGUCAAACGUG | 5258 | CACGUUUGACAUCUUUCUC | | [459-477] 5'UTR+ORF |
| 339 | 4759 | CUUUGAUUUACAGCAAGUA | 5259 | UACUUGCUGUAAAUCAAAG | | [1414-1432] 3'UTR |
| 340 | 4760 | UUGCUUUGAUUUACAGCAA | 5260 | UUGCUGUAAAUCAAAGCAA | | [1411-1429] 3'UTR |
| 341 | 4761 | CUAAAAGCGUUGGAUGUAG | 5261 | CUACAUCCAACGCUUUUAG | | [1250-1268] 3'UTR |
| 342 | 4762 | GACUUCAUGGAAUGGACAU | 5262 | AUGUCCAUUCCAUGAAGUC | | [1162-1180] 3'UTR |
| 343 | 4763 | AGAGACAUGGAAGAGGCGA | 5263 | UCGCCUCUUCCAUGUCUCU | Chn | [613-631] ORF |
| 344 | 4764 | CAAAGUGGCAUGUUUUGUG | 5264 | CACAAAACAUGCCACUUUG | Ms | [2216-2234] 3'UTR |
| 345 | 4765 | AGCCAAAGUGGCAUGUUUU | 5265 | AAAACAUGCCACUUUGGCU | Ms | [2213-2231] 3'UTR |
| 346 | 4766 | UGCAUGUGGCUUUUUUAAA | 5266 | UUUAAAAAAGCCACAUGCA | | [1657-1675] 3'UTR |
| 347 | 4767 | UCUAAAAGCGUUGGAUGUA | 5267 | UACAUCCAACGCUUUUAGA | | [1249-1267] 3'UTR |
| 348 | 4768 | GCCUCUAAAAGCGUUGGAU | 5268 | AUCCAACGCUUUUAGAGGC | | [1246-1264] 3'UTR |
| 349 | 4769 | AGGCACUCUUAAAUGAUCU | 5269 | AGAUCAUUUAAGAGUGCCU | | [1227-1245] 3'UTR |
| 350 | 4770 | GCGCUUUGUUUUGUUCGGU | 5270 | ACCGAACAAAACAAAGCGC | | [396-414] 5'UTR |
| 351 | 4771 | UACAUCACUGCUUGAUGAA | 5271 | UUCAUCAAGCAGUGAUGUA | | [1101-1119] 3'UTR |
| 352 | 4772 | AUACAUCACUGCUUGAUGA | 5272 | UCAUCAAGCAGUGAUGUAU | | [1100-1118] 3'UTR |
| 353 | 4773 | AACAGCUCGAAUUAAGAAU | 5273 | AUUCUUAAUUCGAGCUGUU | | [1062-1080] 3'UTR |
| 354 | 4774 | CGCAGGAAUAAGGAAGCGA | 5274 | UCGCUUCCUUAUUCCUGCG | | [909-927] ORF |
| 355 | 4775 | AGUCCAUUUGAUCAGCGGA | 5275 | UCCGCUGAUCAAAUGGACU | | [241-259] 5'UTR |
| 356 | 4776 | CGCCAGUCCAUUUGAUCAG | 5276 | CUGAUCAAAUGGACUGGCG | | [237-255] 5'UTR |
| 357 | 4777 | UUCGAUUUCAGAAUCACA | 5277 | UGUGAUUCUGAAAAUCGAA | GP,Chn | [649-667] ORF |

FIGURE 4 Continued

| | | | | | | |
|---|---|---|---|---|---|---|
| 358 | 4778 | AGAAGCACUGCAGAGACAU | 5278 | AUGUCUCUGCAGUGCUUCU | GP,Chn | [602-620] ORF |
| 359 | 4779 | UUGCAUACUGAGCCAAGUA | 5279 | UACUUGGCUCAGUAUGCAA | Ms | [2308-2326] 3'UTR |
| 360 | 4780 | CAUUUGUAAAUGCUGUGUU | 5280 | AACACAGCAUUUACAAAUG | | [2235-2253] 3'UTR |
| 361 | 4781 | ACUUGGAGAAGCACUGCAG | 5281 | CUGCAGUGCUUCUCCAAGU | GP,Chn | [596-614] ORF |
| 362 | 4782 | GACAAUAUACAAGCCAAAG | 5282 | CUUUGGCUUGUAUAUUGUC | Ms | [2202-2220] 3'UTR |
| 363 | 4783 | GGAAAAACCAUUUGAAGUG | 5283 | CACUUCAAAUGGUUUUUCC | | [2106-2124] 3'UTR |
| 364 | 4784 | UGUGUAUGGAAAAACCAUU | 5284 | AAUGGUUUUUCCAUACACA | | [2099-2117] 3'UTR |
| 365 | 4785 | GCCUGUGUAUGGAAAAACC | 5285 | GGUUUUUCCAUACACAGGC | | [2096-2114] 3'UTR |
| 366 | 4786 | AGAAAAGCACACUUGUAGG | 5286 | CCUACAAGUGUGCUUUUCU | | [2036-2054] 3'UTR |
| 367 | 4787 | CACAGGAAAGUGUUAUUUU | 5287 | AAAAUAACACUUUCCUGUG | | [1998-2016] 3'UTR |
| 368 | 4788 | UCCACAGGAAAGUGUUAUU | 5288 | AAUAACACUUUCCUGUGGA | | [1996-2014] 3'UTR |
| 369 | 4789 | UUGACCAUCUGCUUUUAUU | 5289 | AAUAAAAGCAGAUGGUCAA | | [1820-1838] 3'UTR |
| 370 | 4790 | CUUGGGAGUUUUGAAUGUU | 5290 | AACAUUCAAAACUCCCAAG | | [1796-1814] 3'UTR |
| 371 | 4791 | UUUUUGAGAGUGCGAGAGA | 5291 | UCUCUCGCACUCUCAAAAA | | [421-439] 5'UTR |
| 372 | 4792 | GAAGAGAAGCAAUUUUGGG | 5292 | CCCAAAAUUGCUUCUCUUC | | [1453-1471] 3'UTR |
| 373 | 4793 | AGCUUGCUUUGAUUUACAG | 5293 | CUGUAAAUCAAAGCAAGCU | | [1408-1426] 3'UTR |
| 374 | 4794 | GUUCGGUUUUGUUUUUUUG | 5294 | CAAAAAAACAAAACCGAAC | | [408-426] 5'UTR |
| 375 | 4795 | AACGUAAACAGCUCGAAUU | 5295 | AAUUCGAGCUGUUUACGUU | | [1056-1074] ORF+3'UTR |
| 376 | 4796 | UCAGAAGACGUCAAACGUA | 5296 | UACGUUUGACGUCUUCUGA | | [1043-1061] ORF |
| 377 | 4797 | ACCUGCAACCGACGAUUCU | 5297 | AGAAUCGUCGGUUGCAGGU | | [927-945] ORF |
| 378 | 4798 | AGCUUGCCCGAGUUCUACU | 5298 | AGUAGAACUCGGGCAAGCU | Rat,Ms | [712-730] ORF |
| 379 | 4799 | UCCCUUCCACCGCCAUAUU | 5299 | AAUAUGGCGGUGGAAGGGA | Ms | [8-26] 5'UTR |
| 380 | 4800 | UGUGAAAAAGAUGCCAAUU | 5300 | AAUUGGCAUCUUUUUCACA | Ms | [2342-2360] 3'UTR |
| 381 | 4801 | AUGUGUGAAAAAGAUGCCA | 5301 | UGGCAUCUUUUUCACACAU | Ms | [2339-2357] 3'UTR |
| 382 | 4802 | CUUAAAAGGUUGCAUACUG | 5302 | CAGUAUGCAACCUUUUAAG | Ms | [2299-2317] 3'UTR |
| 383 | 4803 | UGUAAAUGCUGUGUUGGGU | 5303 | ACCCAACACAGCAUUUACA | | [2239-2257] 3'UTR |
| 384 | 4804 | ACAAUAUACAAGCCAAAGU | 5304 | ACUUUGGCUUGUAUAUUGU | Ms | [2203-2221] 3'UTR |
| 385 | 4805 | GAAGAGUUAACCCGGGACU | 5305 | AGUCCCGGGUUAACUCUUC | GP,Chn | [580-598] ORF |
| 386 | 4806 | GAGGUGCUUGGGAGUUUUG | 5306 | CAAAACUCCCAAGCACCUC | | [1790-1808] 3'UTR |
| 387 | 4807 | GCAGAAUGGUGAUCACUCC | 5307 | GGAGUGAUCACCAUUCUGC | | [1749-1767] 3'UTR |
| 388 | 4808 | AGCUGCAUGUGGCUUUUUU | 5308 | AAAAAAGCCACAUGCAGCU | | [1654-1672] 3'UTR |
| 389 | 4809 | ACAAAAAUUUGAACACUGG | 5309 | CCAGUGUUCAAAUUUUUGU | | [1546-1564] 3'UTR |
| 390 | 4810 | CCUUUCAGAGACAGCUGAU | 5310 | AUCAGCUGUCUCUGAAAGG | | [1509-1527] 3'UTR |
| 391 | 4811 | AGAGCUUGCUUUGAUUUAC | 5311 | GUAAAUCAAAGCAAGCUCU | | [1406-1424] 3'UTR |
| 392 | 4812 | GGUUUUGUUUUUUUGAGAG | 5312 | CUCUCAAAAAAACAAAACC | | [412-430] 5'UTR |
| 393 | 4813 | UUGUACUACCUGUGUAUAU | 5313 | AUAUACACAGGUAGUACAA | Rat,Ms,GP,Chn | [1303-1321] 3'UTR |
| 394 | 4814 | UGUUUUGUUCGGUUUUGUU | 5314 | AACAAAACCGAACAAAACA | | [402-420] 5'UTR |
| 395 | 4815 | UUAGGCACUCUUAAAUGAU | 5315 | AUCAUUUAAGAGUGCCUAA | | [1225-1243] 3'UTR |
| 396 | 4816 | GUUUAUCAGAUACAUCACU | 5316 | AGUGAUGUAUCUGAUAAAC | | [1091-1109] 3'UTR |
| 397 | 4817 | UCCUUGUUUAUCAGAUACA | 5317 | UGUAUCUGAUAAACAAGGA | Chn | [1086-1104] 3'UTR |
| 398 | 4818 | CAGUCCAUUUGAUCAGCGG | 5318 | CCGCUGAUCAAAUGGACUG | | [240-258] 5'UTR |
| 399 | 4819 | GUAAUGUGUGAAAAAGAUG | 5319 | CAUCUUUUUCACACAUUAC | Ms | [2336-2354] 3'UTR |
| 400 | 4820 | AUGCUUAAAAGGUUGCAUA | 5320 | UAUGCAACCUUUUAAGCAU | | [2296-2314] 3'UTR |
| 401 | 4821 | UAUACAAGCCAAAGUGGCA | 5321 | UGCCACUUUGGCUUGUAUA | Ms | [2207-2225] 3'UTR |
| 402 | 4822 | UGAAGUGUACCUGUGUACA | 5322 | UGUACACAGGUACACUUCA | | [2118-2136] 3'UTR |
| 403 | 4823 | CUUACUCUGUCCAUUUAUC | 5323 | GAUAAAUGGACAGAGUAAG | | [1979-1997] 3'UTR |
| 404 | 4824 | AACCUAUCCUCACUGCCCU | 5324 | AGGGCAGUGAGGAUAGGUU | | [1687-1705] 3'UTR |
| 405 | 4825 | GCAACAGAAACCUAUCCUC | 5325 | GAGGAUAGGUUUCUGUUGC | | [1679-1697] 3'UTR |
| 406 | 4826 | ACCCGGGAGAAAGAUGUCA | 5326 | UGACAUCUUUCUCCCGGGU | | [453-471] 5'UTR+ORF |
| 407 | 4827 | CAAAAAUUUGAACACUGGC | 5327 | GCCAGUGUUCAAAUUUUUG | | [1547-1565] 3'UTR |
| 408 | 4828 | AAAGAUGUAAUGUCCCUUU | 5328 | AAAGGGACAUUACAUCUUU | | [1495-1513] 3'UTR |
| 409 | 4829 | AUAUUUGACUUGCAUGAAG | 5329 | CUUCAUGCAAGUCAAAUAU | | [1438-1456] 3'UTR |
| 410 | 4830 | UAUGAAGAGCUUGCUUUGA | 5330 | UCAAAGCAAGCUCUUCAUA | | [1401-1419] 3'UTR |
| 411 | 4831 | CUAAAAUUUUAGGCACUCU | 5331 | AGAGUGCCUAAAAUUUUAG | Ms,GP,Chn | [1217-1235] 3'UTR |
| 412 | 4832 | AGCACUGAAAAACAACAAC | 5332 | GUUGUUGUUUUUCAGUGCU | | [1189-1207] 3'UTR |
| 413 | 4833 | UGGAAUGGACAUCCUGUAU | 5333 | AUACAGGAUGUCCAUUCCA | GP,Chn | [1169-1187] 3'UTR |
| 414 | 4834 | CUCAGAAGACGUCAAACGU | 5334 | ACGUUUGACGUCUUCUGAG | | [1042-1060] ORF |
| 415 | 4835 | UUGCCCGAGUUCUACUACA | 5335 | UGUAGUAGAACUCGGGCAA | Rat,Ms,GP,Chn | [715-733] ORF |
| 416 | 4836 | UAAAAGGUUGCAUACUGAG | 5336 | CUCAGUAUGCAACCUUUUA | Ms | [2301-2319] 3'UTR |
| 417 | 4837 | AUUUGUAAAUGCUGUGUUG | 5337 | CAACACAGCAUUUACAAAU | | [2238-2254] 3'UTR |
| 418 | 4838 | AUUUGAAGUGUACCUGUGU | 5338 | ACACAGGUACACUUCAAAU | | [2115-2133] 3'UTR |
| 419 | 4839 | UAUUUCAUUGCCUGUGUAU | 5339 | AUACACAGGCAAUGAAAUA | | [2087-2105] 3'UTR |

FIGURE 4 Continued

| | | | | | | |
|---|---|---|---|---|---|---|
| 420 | 4840 | CUGUAAGUAACUUCACAUU | 5340 | AAUGUGAAGUUACUUACAG | | [1932-1950] 3'UTR |
| 421 | 4841 | GGUGAUCUCCCAAGCUAUC | 5341 | GAUAGCUUGGGAGAUCACC | | [1620-1638] 3'UTR |
| 422 | 4842 | CUUUAAAGAUGUAAUGUCC | 5342 | GGACAUUACAUCUUUAAAG | | [1491-1509] 3'UTR |
| 423 | 4843 | AUCACUGCUUGAUGAAGCA | 5343 | UGCUUCAUCAAGCAGUGAU | | [1104-1122] 3'UTR |
| 424 | 4844 | UGUUUAUCAGAUACAUCAC | 5344 | GUGAUGUAUCUGAUAAACA | | [1090-1108] 3'UTR |
| 425 | 4845 | CGUCAAACGUAAACAGCUC | 5345 | GAGCUGUUUACGUUUGACG | Chn | [1051-1069] ORF+3'UTR |
| 426 | 4846 | UAAGGAAGCGACCUGCAAC | 5346 | GUUGCAGGUCGCUUCCUUA | | [917-935] ORF |
| 427 | 4847 | UGUCCAUUUAUCCACAGGA | 5347 | UCCUGUGGAUAAAUGGACA | | [1986-2004] 3'UTR |
| 428 | 4848 | AUUGGGCCACUAAAAAAAG | 5348 | CUUUUUUUAGUGGCCCAAU | | [24-42] 5'UTR |
| 429 | 4849 | UAAGAAUUGACCAUCUGCU | 5349 | AGCAGAUGGUCAAUUCUUA | | [1814-1832] 3'UTR |
| 430 | 4850 | GUUAGAUAGCUGCAUGUGG | 5350 | CCACAUGCAGCUAUCUAAC | | [1647-1665] 3'UTR |
| 431 | 4851 | CUCCCAAGCUAUCUAAAGU | 5351 | ACUUUAGAUAGCUUGGGAG | | [1626-1644] 3'UTR |
| 432 | 4852 | AUUUGACUUGCAUGAAGAG | 5352 | CUCUUCAUGCAAGUCAAAU | | [1440-1458] 3'UTR |
| 433 | 4853 | UACCUUUUAUGUAGCACAU | 5353 | AUGUGCUACAUAAAAGGUA | | [1328-1346] 3'UTR |
| 434 | 4854 | AUUGUACUACCUGUGUAUA | 5354 | UAUACACAGGUAGUACAAU | Rat,GP,Chn | [1302-1320] 3'UTR |
| 435 | 4855 | UAGCAUUAUGCAAUUAGGU | 5355 | ACCUAAUUGCAUAAUGCUA | | [1266-1284] 3'UTR |
| 436 | 4856 | GAUCUGCCUCUAAAAGCGU | 5356 | ACGCUUUAGAGGCAGAUC | | [1241-1259] 3'UTR |
| 437 | 4857 | AUACAUAUCGCUGACUUCA | 5357 | UGAAGUCAGCGAUAUGUAU | | [1150-1168] 3'UTR |
| 438 | 4858 | AAAUGCCGGUUCUGUGGAG | 5358 | CUCCACAGAACCGGCAUUU | | [1002-1020] ORF |
| 439 | 4859 | ACUCUGAGGACACGCAUUU | 5359 | AAAUGCGUGUCCUCAGAGU | | [836-854] ORF |
| 440 | 4860 | CAAGUACGAGUGGCAAGAG | 5360 | CUCUUGCCACUCGUACUUG | | [681-699] ORF |
| 441 | 4861 | GAUUUUCAGAAUCACAAAC | 5361 | GUUUGUGAUUCUGAAAAUC | | [652-670] ORF |
| 442 | 4862 | UGUGUACAUAACUCUGUAA | 5362 | UUACAGAGUUAUGUACACA | | [2129-2147] 3'UTR |
| 443 | 4863 | AAGAGUUAACCCGGGACUU | 5363 | AAGUCCCGGGUUAACUCUU | GP,Chn | [581-599] ORF |
| 444 | 4864 | AUGUCAAACGUGCGAGUGU | 5364 | ACACUCGCACGUUUGACAU | | [466-484] ORF |
| 445 | 4865 | GAUCACUCCAGGUAGUUUG | 5365 | CAAACUACCUGGAGUGAUC | | [1759-1777] 3'UTR |
| 446 | 4866 | AGAAAGAUGUCAAACGUGC | 5366 | GCACGUUUGACAUCUUUCU | | [460-478] 5'UTR+ORF |
| 447 | 4867 | AUAGCUGCAUGUGGCUUUU | 5367 | AAAAGCCACAUGCAGCUAU | | [1652-1670] 3'UTR |
| 448 | 4868 | UUUUUGAGAGUGCGAGAGAG | 5368 | CUCUCUCGCACUCUCAAAA | | [422-440] 5'UTR |
| 449 | 4869 | GGCACUCUUAAAUGAUCUG | 5369 | CAGAUCAUUUAAGAGUGCC | | [1228-1246] 3'UTR |
| 450 | 4870 | AUAUCGCUGACUUCAUGGA | 5370 | UCCAUGAAGUCAGCGAUAU | | [1154-1172] 3'UTR |
| 451 | 4871 | AAAAAUACAUAUCGCUGAC | 5371 | GUCAGCGAUAUGUAUUUUU | | [1146-1164] 3'UTR |
| 452 | 4872 | UGCAACCGACGAUUCUUCU | 5372 | AGAAGAAUCGUCGGUUGCA | | [930-948] ORF |
| 453 | 4873 | CAGGAAUAAGGAAGCGACC | 5373 | GGUCGCUUCCUUAUUCCUG | | [911-929] ORF |
| 454 | 4874 | UACUGAGCCAAGUAUAAUU | 5374 | AAUUAUACUUGGCUCAGUA | Ms | [2313-2331] 3'UTR |
| 455 | 4875 | AAAACCAUUUGAAGUGUAC | 5375 | GUACACUUCAAAUGGUUUU | | [2109-2127] 3'UTR |
| 456 | 4876 | AAACAGUAUUUCAUUGCCU | 5376 | AGGCAAUGAAAUACUGUUU | | [2081-2099] 3'UTR |
| 457 | 4877 | UUAUCCACAGGAAAGUGUU | 5377 | AACACUUUCCUGUGGAUAA | | [1993-2011] 3'UTR |
| 458 | 4878 | UUCGGGCUGUGUAAACACA | 5378 | UGUGUUUACACAGCCCGAA | | [1875-1893] 3'UTR |
| 459 | 4879 | CAAAAAUCCGAGGUGCUUG | 5379 | CAAGCACCUCGGAUUUUUG | | [1781-1799] 3'UTR |
| 460 | 4880 | UCUCUCUUAAAGUUGGAAU | 5380 | AUUCCAACUUUAAGAGAGA | | [1712-1730] 3'UTR |
| 461 | 4881 | CUUGCUUUGAUUUACAGCA | 5381 | UGCUGUAAAUCAAAGCAAG | | [1410-1428] 3'UTR |
| 462 | 4882 | UCCUUAUUUGCUUCAUUGU | 5382 | ACAAUGAAGCAAAUAAGGA | Rat,GP,Chn | [1288-1306] 3'UTR |
| 463 | 4883 | AAAGCGUUGGAUGUAGCAU | 5383 | AUGCUACAUCCAACGCUUU | | [1253-1271] 3'UTR |
| 464 | 4884 | GACAUCCUGUAUAAGCACU | 5384 | AGUGCUUAUACAGGAUGUC | Rat,Ms,GP,Chn | [1176-1194] 3'UTR |
| 465 | 4885 | UGUGUCUUUUGGCUCCGAG | 5385 | CUCGGAGCCAAAAGACACA | | [335-353] 5'UTR |
| 466 | 4886 | GAAGAAAAUGUUUCAGACG | 5386 | CGUCUGAAACAUUUUCUUC | Rat,Ms,GP,Chn | [976-994] ORF |
| 467 | 4887 | UCCAUUUGAUCAGCGGAGA | 5387 | UCUCCGCUGAUCAAAUGGA | | [243-261] 5'UTR |
| 468 | 4888 | CCCGAGUUCUACUACAGAC | 5388 | GUCUGUAGUAGAACUCGGG | Rat,GP,Chn | [718-736] ORF |
| 469 | 4889 | ACUGAGCCAAGUAUAAUUU | 5389 | AAAUUAUACUUGGCUCAGU | Ms | [2314-2332] 3'UTR |
| 470 | 4890 | ACCUGUGUACAUAACUCUG | 5390 | CAGAGUUAUGUACACAGGU | | [2126-2144] 3'UTR |
| 471 | 4891 | GUAGAGAAAAGCACACUUG | 5391 | CAAGUGUGCUUUUCUCUAC | | [2032-2050] 3'UTR |
| 472 | 4892 | UUUUAAAGGAAGGUUCAUGU | 5392 | ACAUGAACCUUCCUUUAAA | | [2015-2033] 3'UTR |
| 473 | 4893 | UCUAAAUCCCUCGAUAUUU | 5393 | AAAUAUCGAGGGAUUUAGA | | [1905-1923] 3'UTR |
| 474 | 4894 | UUUCACUUCGGGCUGUGUA | 5394 | UACACAGCCCGAAGUGAAA | | [1869-1887] 3'UTR |
| 475 | 4895 | AAGUUGGAAUUUACCAGUU | 5395 | AACUGGUAAAUUCCAACUU | | [1721-1739] 3'UTR |
| 476 | 4896 | ACCUUUUAUGUAGCACAUA | 5396 | UAUGUGCUACAUAAAAGGU | | [1329-1347] 3'UTR |
| 477 | 4897 | GUUUUGUUCGGUUUUUGUUU | 5397 | AAACAAAACCGAACAAAAC | | [403-421] 5'UTR |
| 478 | 4898 | AGCUCGAAUUAAGAAUAUG | 5398 | CAUAUUCUUAAUUCGAGCU | | [1065-1083] 3'UTR |
| 479 | 4899 | ACGUCAAACGUAAACAGCU | 5399 | AGCUGUUUACGUUUGACGU | Chn | [1050-1068] ORF+3'UTR |
| 480 | 4900 | CUCUGAGGACACGCAUUUG | 5400 | CAAAUGCGUGUCCUCAGAG | | [837-855] ORF |
| 481 | 4901 | GCCAAAGUGGCAUGUUUUG | 5401 | CAAAACAUGCCACUUUGGC | Ms | [2214-2232] 3'UTR |

FIGURE 4 Continued

| No. | SEQ ID NO | Sense siRNA | SEQ ID NO | AntiSense siRNA | Other Sp | Human-47132606 ORF:213-683 | Human-98985803 ORF:213-563 | Human-47132605 ORF:38-559 |
|---|---|---|---|---|---|---|---|---|
| 482 | 4902 | UUAACCCGGGACUUGGAGA | 5402 | UCUCCAAGUCCCGGGUUAA | GP,Chn | [586-604] ORF | | |
| 483 | 4903 | UUCAUUGCCUGUGUAUGGA | 5403 | UCCAUACACAGGCAAUGAA | | [2090-2108] 3'UTR | | |
| 484 | 4904 | UGGACCACGAAGAGUUAAC | 5404 | GUUAACUCUUCGUGGUCCA | | [572-590] ORF | | |
| 485 | 4905 | AAAGUUGGAAUUUACCAGU | 5405 | ACUGGUAAAUUCCAACUUU | | [1720-1738] 3'UTR | | |
| 486 | 4906 | UUGUUAGAUAGCUGCAUGU | 5406 | ACAUGCAGCUAUCUAACAA | | [1645-1663] 3'UTR | | |
| 487 | 4907 | AAAGUUUGUUAGAUAGCUG | 5407 | CAGCUAUCUAACAAACUUU | | [1640-1658] 3'UTR | | |
| 488 | 4908 | UUGGAUGUAGCAUUAUGCA | 5408 | UGCAUAAUGCUACAUCCAA | | [1259-1277] 3'UTR | | |
| 489 | 4909 | UCAUGGAAUGGACAUCCUG | 5409 | CAGGAUGUCCAUUCCAUGA | | [1166-1184] 3'UTR | | |
| 490 | 4910 | CUUGUUUAUCAGAUACAUC | 5410 | GAUGUAUCUGAUAAACAAG | | [1088-1106] 3'UTR | | |
| 491 | 4911 | AAGACGUCAAACGUAAACA | 5411 | UGUUUACGUUUGACGUCUU | Chn | [1047-1065] ORF+3'UTR | | |
| 492 | 4912 | GAAGACGUCAAACGUAAAC | 5412 | GUUUACGUUUGACGUCUUC | Chn | [1046-1064] ORF+3'UTR | | |
| 493 | 4913 | CAACCGACGAUUCUUCUAC | 5413 | GUAGAAGAAUCGUCGGUUG | | [932-950] ORF | | |
| 494 | 4914 | AAGUACGAGUGGCAAGAGG | 5414 | CCUCUUGCCACUCGUACUU | | [682-700] ORF | | |
| 495 | 4915 | UGGAAAAACCAUUUGAAGU | 5415 | ACUUCAAAUGGUUUUUCCA | | [2105-2123] 3'UTR | | |
| 496 | 4916 | GAUAAGUGAAAUGGAUACU | 5416 | AGUAUCCAUUUCACUUAUC | | [2054-2072] 3'UTR | | |
| 497 | 4917 | AGCACACUUGUAGGAUAAG | 5417 | CUUAUCCUACAAGUGUGCU | | [2041-2059] 3'UTR | | |
| 498 | 4918 | AAACGUGCGAGUGUCUAAC | 5418 | GUUAGACACUCGCACGUUU | | [471-489] ORF | | |
| 499 | 4919 | UACUCAGCAGAAUGGUGAU | 5419 | AUCACCAUUCUGCUGAGUA | | [1743-1761] 3'UTR | | |
| 500 | 4920 | AAUGAUCUGCCUCUAAAAG | 5420 | CUUUUAGAGGCAGAUCAUU | | [1238-1256] 3'UTR | | |

Table A7 CDKN2A - cyclin-dependent kinase inhibitor 2A (melanoma, p16, inhibits CDK4)

| No. | SEQ ID NO. | Sense siRNA | SEQ ID NO. | AntiSense siRNA | Other Sp | Human-47132606 ORF:213-683 | Human-98985803 ORF:213-563 | Human-47132605 ORF:38-559 |
|---|---|---|---|---|---|---|---|---|
| 1 | 5421 | CCGUAAAUGUCCAUUUAUA | 5632 | UAUAAAUGGACAUUUACGG | | [860-878] 3'UTR | [1134-1152] 3'UTR | [851-869] 3'UTR |
| 2 | 5422 | AGCAAAUGGCAGAACCAAA | 5633 | UUUGGUUCUGCCAUUUGCU | Chp | [1103-1121] 3'UTR | [1377-1395] 3'UTR | [1094-1112] 3'UTR |
| 3 | 5423 | GCCUUUUAACGUAGAUAUA | 5634 | UAUAUCUACGUUAAAAGGC | Chp | [826-844] 3'UTR | [1100-1118] 3'UTR | [817-835] 3'UTR |
| 4 | 5424 | CCCGAUUGAAAGAACCAGA | 5635 | UCUGGUUCUUUCAAUCGGG | Chp | [675-693] ORF+3'UTR | [949-967] 3'UTR | [666-684] 3'UTR |
| 5 | 5425 | CGAUUGAAAGAACCAGAGA | 5636 | UCUCUGGUUCUUUCAAUCG | Chp | [677-695] ORF+3'UTR | [951-969] 3'UTR | [668-686] 3'UTR |
| 6 | 5426 | GGGAAACUUAGAUCAUCAG | 5637 | CUGAUGAUCUAAGUUUCCC | | [712-730] 3'UTR | [986-1004] 3'UTR | [703-721] 3'UTR |
| 7 | 5427 | CUCGGGAAACUUAGAUCAU | 5638 | AUGAUCUAAGUUUCCCGAG | | [709-727] 3'UTR | [983-1001] 3'UTR | [700-718] 3'UTR |
| 8 | 5428 | AAAAUGCCUGCCUUUUAA | 5639 | UUAAAAGGCAGGACAUUUU | | [816-834] 3'UTR | [1090-1108] 3'UTR | [807-825] 3'UTR |
| 9 | 5429 | CAGUAACCAUGCCCGCAUA | 5640 | UAUGCGGGCAUGGUUACUG | Chp | [629-647] ORF | [903-921] 3'UTR | [620-638] 3'UTR |
| 10 | 5430 | GGAAACUUAGAUCAUCAGU | 5641 | ACUGAUGAUCUAAGUUUCC | Chp | [713-731] 3'UTR | [987-1005] 3'UTR | [704-722] 3'UTR |
| 11 | 5431 | CAUUUUGUGAACUAGGGAA | 5642 | UUCCCUAGUUCACAAAAUG | Chp | [1045-1063] 3'UTR | [1319-1337] 3'UTR | [1036-1054] 3'UTR |
| 12 | 5432 | CUCGAGAAACCUCGGGAAA | 5643 | UUUCCCGAGGUUUCUCGAG | | [698-716] 3'UTR | [972-990] 3'UTR | [689-707] 3'UTR |
| 13 | 5433 | GCAUUUUGUGAACUAGGGA | 5644 | UCCCUAGUUCACAAAAUGC | Chp | [1044-1062] 3'UTR | [1318-1336] 3'UTR | [1035-1053] 3'UTR |
| 14 | 5434 | CGGAAGCUGUCGACUUCAU | 5645 | AUGAAGUCGACAGCUUCCG | Chp | [1020-1038] 3'UTR | [1294-1312] 3'UTR | [1011-1029] 3'UTR |
| 15 | 5435 | CCAGAGAGGCUCGGAGAAA | 5646 | UUUCUCCGAGCCUCUCUGG | Chp | [689-707] 3'UTR | [963-981] 3'UTR | [680-698] 3'UTR |
| 16 | 5436 | AAACCUCGGGAAACUUAGA | 5647 | UCUAAGUUUCCCGAGGUUU | | [705-723] 3'UTR | [979-997] 3'UTR | [696-714] 3'UTR |
| 17 | 5437 | GGUUACUGGCUUCUCUUGA | 5648 | UCAAGAGAAGCCAGUAACC | Chp | [1073-1091] 3'UTR | [1347-1365] 3'UTR | [1064-1082] 3'UTR |
| 18 | 5438 | CAUUCAUGUGGGCAUUUCU | 5649 | AGAAAUGCCCACAUGAAUG | | [983-1001] 3'UTR | [1257-1275] 3'UTR | [974-992] 3'UTR |
| 19 | 5439 | UGUCCUGCCUUUUAACGUA | 5650 | UACGUUAAAAGGCAGGACA | | [820-838] 3'UTR | [1094-1112] 3'UTR | [811-829] 3'UTR |
| 20 | 5440 | CCGCUUUCGUAGUUUUCAU | 5651 | AUGAAAACUACGAAAGCGG | Chp | [778-796] 3'UTR | [1052-1070] 3'UTR | [769-787] 3'UTR |
| 21 | 5441 | CCUCGGGAAACUUAGAUCA | 5652 | UGAUCUAAGUUUCCCGAGG | Chp | [708-726] 3'UTR | [982-1000] 3'UTR | [699-717] 3'UTR |
| 22 | 5442 | UACCGUAAAUGUCCAUUUA | 5653 | UAAAUGGACAUUUACGGUA | Chp | [858-876] 3'UTR | [1132-1150] 3'UTR | [849-867] 3'UTR |
| 23 | 5443 | UCGCUUCAUGACAAGCAU | 5654 | AUGCUUGUCAUGAAGUCGA | | [1029-1047] 3'UTR | [1303-1321] 3'UTR | [1020-1038] 3'UTR |
| 24 | 5444 | CCUGCCUUUUAACGUAGAU | 5655 | AUCUACGUUAAAAGGCAGG | Chp | [823-841] 3'UTR | [1097-1115] 3'UTR | [814-832] 3'UTR |
| 25 | 5445 | CGACUUCAUGACAAGCAUU | 5656 | AAUGCUUGUCAUGAAGUCG | | [1030-1048] 3'UTR | [1304-1322] 3'UTR | [1021-1039] 3'UTR |
| 26 | 5446 | GAAACCUCGGGAAACUUAG | 5657 | CUAAGUUUCCCGAGGUUUC | | [704-722] 3'UTR | [978-996] 3'UTR | [695-713] 3'UTR |
| 27 | 5447 | CACCAGAGGCAGAACCAU | 5658 | AUGGUUACUGCCUCUGGUG | Chp | [620-638] ORF | [894-912] 3'UTR | [611-629] 3'UTR |
| 28 | 5448 | GCCUUUUCACUGUGUUGGA | 5659 | UCCAACACAGUGAAAAGGC | Chp | [930-948] 3'UTR | [1204-1222] 3'UTR | [921-939] 3'UTR |
| 29 | 5449 | GCUGUCGACUUCAUGACAA | 5660 | UUGUCAUGAAGUCGACAGC | Chp | [1025-1043] 3'UTR | [1299-1317] 3'UTR | [1016-1034] 3'UTR |
| 30 | 5450 | GAAGCUGUCGACUUCAUGA | 5661 | UCAUGAAGUCGACAGCUUC | Chp | [1022-1040] 3'UTR | [1296-1314] 3'UTR | [1013-1031] 3'UTR |
| 31 | 5451 | GAGUUUUCUGGAGUGAGCA | 5662 | UGCUCACUCCAGAAAACUC | Chp | [947-965] 3'UTR | [1221-1239] 3'UTR | [938-956] 3'UTR |
| 32 | 5452 | CCACUACCGUAAAUGUCCA | 5663 | UGGACAUUUACGGUAGUGG | | [854-872] 3'UTR | [1128-1146] 3'UTR | [845-863] 3'UTR |
| 33 | 5453 | UGAGUCACACUGGUCAGCAA | 5664 | UUGCUAGCAGUGUGACUCA | Chp | [1089-1107] 3'UTR | [1363-1381] 3'UTR | [1080-1098] 3'UTR |
| 34 | 5454 | CGCACAUUCAUGUGGGCAU | 5665 | AUGCCCACAUGAAUGUGCG | | [979-997] 3'UTR | [1253-1271] 3'UTR | [970-988] 3'UTR |
| 35 | 5455 | CCGAUUGAAAGAACCAGAG | 5666 | CUCUGGUUCUUUCAAUCGG | Chp | [676-694] ORF+3'UTR | [950-968] 3'UTR | [667-685] 3'UTR |
| 36 | 5456 | UAACCAUGCCCGCAUAGAU | 5667 | AUCUAUGCGGGCAUGGUUA | Chp | [632-650] ORF | [906-924] 3'UTR | [623-641] 3'UTR |

FIGURE 4 Continued

| | | | | | | | | |
|---|---|---|---|---|---|---|---|---|
| 37 | 5457 | ACAAGCAUUUUGUGAACUA | 5688 | UAGUUCACAAAAUGCUUGU | | [1040-1058] 3'UTR | [1314-1332] 3'UTR | [1031-1049] 3'UTR |
| 38 | 5458 | GCUUCUGCCUUUUCACUGU | 5669 | ACAGUGAAAAGGCAGAAGC | Chp | [924-942] 3'UTR | [1198-1216] 3'UTR | [915-933] 3'UTR |
| 39 | 5459 | CUAGCAAAUGGCAGAACCA | 5670 | UGGUUCUGCCAUUUGCUAG | Chp | [1101-1119] 3'UTR | [1375-1393] 3'UTR | [1092-1110] 3'UTR |
| 40 | 5460 | GGAGUUUUCUGGAGUGAGC | 5671 | GCUCACUCCAGAAAACUCC | Chp | [946-964] 3'UTR | [1220-1238] 3'UTR | [937-955] 3'UTR |
| 41 | 5461 | CUCUUGAGUCACACUGCUA | 5672 | UAGCAGUGUGACUCAAGAG | Chp | [1085-1103] 3'UTR | [1359-1377] 3'UTR | [1076-1094] 3'UTR |
| 42 | 5462 | CAUGACAAGCAUUUUGUGA | 5673 | UCACAAAAUGCUUGUCAUG | | [1036-1054] 3'UTR | [1310-1328] 3'UTR | [1027-1045] 3'UTR |
| 43 | 5463 | AAAAAUGCCUGCCUUUUA | 5674 | UAAAAGGCAGGACAUUUUU | | [815-833] 3'UTR | [1089-1107] 3'UTR | [806-824] 3'UTR |
| 44 | 5464 | CAAGCAUUUUGUGAACUAG | 5675 | CUAGUUCACAAAAUGCUUG | | [1041-1059] 3'UTR | [1315-1333] 3'UTR | [1032-1050] 3'UTR |
| 45 | 5465 | UGUGUUGGAGUUUUCUGGA | 5676 | UCCAGAAAACUCCAACACA | | [940-958] 3'UTR | [1214-1232] 3'UTR | [931-949] 3'UTR |
| 46 | 5466 | AGAUCAUCAGUCACCGAAG | 5677 | CUUCGGUGACUGAUGAUCU | Chp | [721-739] 3'UTR | [995-1013] 3'UTR | [712-730] 3'UTR |
| 47 | 5467 | AACCAGAGAGGCUCUCAGA | 5678 | UCUCAGAGCCUCUCUGGUU | Chp | [687-705] 3'UTR | [961-979] 3'UTR | [678-696] 3'UTR |
| 48 | 5468 | GCUUCUCUUGAGUCACACU | 5679 | AGUGUGACUCAAGAGAAGC | Chp | [1081-1099] 3'UTR | [1355-1373] 3'UTR | [1072-1090] 3'UTR |
| 49 | 5469 | AUGACAAGCAUUUUGUGAA | 5680 | UUCACAAAAUGCUUGUCAU | | [1037-1055] 3'UTR | [1311-1329] 3'UTR | [1028-1046] 3'UTR |
| 50 | 5470 | CGCUUUCGUAGUUUUCAUU | 5681 | AAUGAAAACUACGAAAGCG | Chp | [779-797] 3'UTR | [1053-1071] 3'UTR | [770-788] 3'UTR |
| 51 | 5471 | GAUUGAAAGAACCAGAGAG | 5682 | CUCUCUGGUUCUUUCAAUC | Chp | [678-696] ORF+3'UTR | [952-970] 3'UTR | [669-687] 3'UTR |
| 52 | 5472 | ACUGGCUUCUCUUGAGUCA | 5683 | UGACUCAAGAGAAGCCAGU | Chp | [1077-1095] 3'UTR | [1351-1369] 3'UTR | [1068-1086] 3'UTR |
| 53 | 5473 | CCCUAAGCGCACAUUCAUG | 5684 | CAUGAAUGUGCGCUUAGGG | | [972-990] 3'UTR | [1246-1264] 3'UTR | [963-981] 3'UTR |
| 54 | 5474 | CUGCCUUUUAACGUAGAUA | 5685 | UAUCUACGUUAAAAGGCAG | Chp | [824-842] 3'UTR | [1098-1116] 3'UTR | [815-833] 3'UTR |
| 55 | 5475 | UGCCUUUUAACGUAGAUAU | 5686 | AUAUCUACGUUAAAAGGCA | Chp | [825-843] 3'UTR | [1099-1117] 3'UTR | [816-834] 3'UTR |
| 56 | 5476 | UCCUGCCUUUUAACGUAGA | 5687 | UCUACGUUAAAAGGCAGGA | | [822-840] 3'UTR | [1096-1114] 3'UTR | [813-831] 3'UTR |
| 57 | 5477 | UAGCAAAUGGCAGAACCAA | 5688 | UUGGUUCUGCCAUUUGCUA | Chp | [1102-1120] 3'UTR | [1376-1394] 3'UTR | [1093-1111] 3'UTR |
| 58 | 5478 | CACUGUGUUGGAGUUUUCU | 5689 | AGAAAACUCCAACACAGUG | Chp | [937-955] 3'UTR | [1211-1229] 3'UTR | [928-946] 3'UTR |
| 59 | 5479 | GCACAUUCAUGUGGGCAUU | 5690 | AAUGCCCACAUGAAUGUGC | | [980-998] 3'UTR | [1254-1272] 3'UTR | [971-989] 3'UTR |
| 60 | 5480 | CACUACCGUAAAUGUCCAU | 5691 | AUGGACAUUUACGGUAGUG | | [855-873] 3'UTR | [1129-1147] 3'UTR | [846-864] 3'UTR |
| 61 | 5481 | UAACGUAGAUAUAUGCCUU | 5692 | AAGGCAUAUAUCUACGUUA | Chp | [832-850] 3'UTR | [1106-1124] 3'UTR | [823-841] 3'UTR |
| 62 | 5482 | UGUGAACUAGGGAAGCUCA | 5693 | UGAGCUUCCCUAGUUCACA | Chp | [1050-1068] 3'UTR | [1324-1342] 3'UTR | [1041-1059] 3'UTR |
| 63 | 5483 | AAAUGCCUGCUUUUUAAC | 5694 | GUUAAAAGGCAGGACAUUU | | [817-835] 3'UTR | [1091-1109] 3'UTR | [808-826] 3'UTR |
| 64 | 5484 | UGACAAGCAUUUUGUGAAC | 5695 | GUUCACAAAAUGCUUGUCA | | [1038-1056] 3'UTR | [1312-1330] 3'UTR | [1029-1047] 3'UTR |
| 65 | 5485 | CUGUCGACUUCAUGACAAG | 5696 | CUUGUCAUGAAGUCGACAG | | [1026-1044] 3'UTR | [1300-1318] 3'UTR | [1017-1035] 3'UTR |
| 66 | 5486 | CCUAAGCGCACAUUCAUGU | 5697 | ACAUGAAUGUGCGCUUAGG | | [973-991] 3'UTR | [1247-1265] 3'UTR | [964-982] 3'UTR |
| 67 | 5487 | ACUGCUAGCAAAUGGCAGA | 5698 | UCUGCCAUUUGCUAGCAGU | Chp | [1097-1115] 3'UTR | [1371-1389] 3'UTR | [1088-1106] 3'UTR |
| 68 | 5488 | GGGUUACUGGCUUCUCUUG | 5699 | CAAGAGAAGCCAGUAACCC | Chp | [1072-1090] 3'UTR | [1346-1364] 3'UTR | [1063-1081] 3'UTR |
| 69 | 5489 | ACCAGAGAGGCUCUGAGAA | 5700 | UUCUCAGAGCCUCUCUGGU | Chp | [688-706] 3'UTR | [962-980] 3'UTR | [679-697] 3'UTR |
| 70 | 5490 | AGCUGUCGACUUCAUGACA | 5701 | UGUCAUGAAGUCGACAGCU | Chp | [1024-1042] 3'UTR | [1298-1316] 3'UTR | [1015-1033] 3'UTR |
| 71 | 5491 | CCGCUUCUGCCUUUUCACU | 5702 | AGUGAAAAGGCAGAAGCGG | Chp | [922-940] 3'UTR | [1196-1214] 3'UTR | [913-931] 3'UTR |
| 72 | 5492 | CUACCGUAAAUGUCCAUUU | 5703 | AAAUGGACAUUUACGGUAG | | [857-875] 3'UTR | [1131-1149] 3'UTR | [848-866] 3'UTR |
| 73 | 5493 | UUAAAAAUGCCUGCCUUU | 5704 | AAAGGCAGGACAUUUUUAA | | [813-831] 3'UTR | [1087-1105] 3'UTR | [804-822] 3'UTR |
| 74 | 5494 | GAGCUUUUAAAAAUGUCCU | 5705 | AGGACAUUUUUAAAAGCUC | | [807-825] 3'UTR | [1081-1099] 3'UTR | [798-816] 3'UTR |
| 75 | 5495 | GGAAGCUGUCGACUUCAUG | 5706 | CAUGAAGUCGACAGCUUCC | Chp | [1021-1039] 3'UTR | [1295-1313] 3'UTR | [1012-1030] 3'UTR |
| 76 | 5496 | UGUUGGAGUUUUCUGGAGU | 5707 | ACUCCAGAAAACUCCAACA | Chp | [942-960] 3'UTR | [1216-1234] 3'UTR | [933-951] 3'UTR |
| 77 | 5497 | AAAGAAAACACCGCUUCU | 5708 | AGAAGCGGUGUUUUUCUUU | Chp | [911-929] 3'UTR | [1185-1203] 3'UTR | [902-920] 3'UTR |
| 78 | 5498 | GAUCAUCAGUCACCGAAGG | 5709 | CCUUCGGUGACUGAUGAUC | Chp | [722-740] 3'UTR | [996-1014] 3'UTR | [713-731] 3'UTR |
| 79 | 5499 | UCUCUUGAGUCACACUGCU | 5710 | AGCAGUGUGACUCAAGAGA | Chp | [1084-1102] 3'UTR | [1358-1376] 3'UTR | [1075-1093] 3'UTR |
| 80 | 5500 | CCCGCUUUCGUAGUUUUCA | 5711 | UGAAAACUACGAAAGCGGG | Chp | [777-795] 3'UTR | [1051-1069] 3'UTR | [768-786] 3'UTR |
| 81 | 5501 | CUGCUAGCAAAUGGCAGAA | 5712 | UUCUGCCAUUUGCUAGCAG | Chp | [1098-1116] 3'UTR | [1372-1390] 3'UTR | [1089-1107] 3'UTR |
| 82 | 5502 | GGCUUCUCUUGAGUCACAC | 5713 | GUGUGACUCAAGAGAAGCC | Chp | [1080-1098] 3'UTR | [1354-1372] 3'UTR | [1071-1089] 3'UTR |
| 83 | 5503 | UAGAUCAUCAGUCACCGAA | 5714 | UUCGGUGACUGAUGAUCUA | Chp | [720-738] 3'UTR | [994-1012] 3'UTR | [711-729] 3'UTR |
| 84 | 5504 | AGUCACACUGCUAGCAAAU | 5715 | AUUUGCUAGCAGUGUGACU | Chp | [1091-1109] 3'UTR | [1365-1383] 3'UTR | [1082-1100] 3'UTR |
| 85 | 5505 | UCAUGACAAGCAUUUUGUG | 5716 | CACAAAAUGCUUGUCAUGA | | [1035-1053] 3'UTR | [1309-1327] 3'UTR | [1026-1044] 3'UTR |
| 86 | 5506 | AUUCAUGUGGGCAUUUCUU | 5717 | AAGAAAUGCCCACAUGAAU | | [984-1002] 3'UTR | [1258-1276] 3'UTR | [975-993] 3'UTR |
| 87 | 5507 | GUUGGAGUUUUCUGGAGUG | 5718 | CACUCCAGAAAACUCCAAC | Chp | [943-961] 3'UTR | [1217-1235] 3'UTR | [934-952] 3'UTR |
| 88 | 5508 | CUGUUGGAGUUUUCUGG | 5719 | CCAGAAAACUCCAACACAG | Chp | [939-957] 3'UTR | [1213-1231] 3'UTR | [930-948] 3'UTR |
| 89 | 5509 | AGUCACCGAAGGUCCUACA | 5720 | UGUAGGACCUUCGGUGACU | Chp | [729-747] 3'UTR | [1003-1021] 3'UTR | [720-738] 3'UTR |
| 90 | 5510 | UCUUGAGUCACACUGCUAG | 5721 | CUAGCAGUGUGACUCAAGA | Chp | [1086-1104] 3'UTR | [1360-1378] 3'UTR | [1077-1095] 3'UTR |
| 91 | 5511 | UUAGAUCAUCAGUCACCGA | 5722 | UCGGUGACUGAUGAUCUAA | Chp | [719-737] 3'UTR | [993-1011] 3'UTR | [710-728] 3'UTR |
| 92 | 5512 | GAAACUUAGAUCAUCAGUC | 5723 | GACUGAUGAUCUAAGUUUC | Chp | [714-732] 3'UTR | [988-1006] 3'UTR | [705-723] 3'UTR |
| 93 | 5513 | GUUGGAGUUUUCUGGAG | 5724 | CUCCAGAAAACUCCAACAC | Chp | [941-959] 3'UTR | [1215-1233] 3'UTR | [932-950] 3'UTR |

FIGURE 4 Continued

| | | | | | | | | |
|---|---|---|---|---|---|---|---|---|
| 94 | 5514 | UUUUCACUGUGUUGGAGUU | 5725 | AACUCCAACACAGUGAAAA | Chp | [933-951] 3'UTR | [1207-1225] 3'UTR | [924-942] 3'UTR |
| 95 | 5515 | ACCGUAAAUGUCCAUUUAU | 5726 | AUAAAUGGACAUUUACGGU | | [859-877] 3'UTR | [1133-1151] 3'UTR | [850-868] 3'UTR |
| 96 | 5516 | GUAACCAUGCCCGCAUAGA | 5727 | UCUAUGCGGGCAUGGUUAC | Chp | [631-649] ORF | [905-923] 3'UTR | [622-640] 3'UTR |
| 97 | 5517 | AAAAAAGAAAAACACCGCU | 5728 | AGCGGUGUUUUUCUUUUUU | Chp | [908-926] 3'UTR | [1182-1200] 3'UTR | [899-917] 3'UTR |
| 98 | 5518 | AGCAUUUUGUGAACUAGGG | 5729 | CCCUAGUUCACAAAAUGCU | | [1043-1061] 3'UTR | [1317-1335] 3'UTR | [1034-1052] 3'UTR |
| 99 | 5519 | UGGAGUUUUCUGGAGUGAG | 5730 | CUCACUCCAGAAAACUCCA | Chp | [945-963] 3'UTR | [1219-1237] 3'UTR | [936-954] 3'UTR |
| 100 | 5520 | UAAAAAUGUCCUGCCUUUU | 5731 | AAAAGGCAGGACAUUUUUA | | [814-832] 3'UTR | [1088-1106] 3'UTR | [805-823] 3'UTR |
| 101 | 5521 | CUGAGAAACCUCGGGAAAC | 5732 | GUUUCCCGAGGUUUCUCAG | | [700-718] 3'UTR | [974-992] 3'UTR | [691-709] 3'UTR |
| 102 | 5522 | GAGAGGCUCUGAGAAACCU | 5733 | AGGUUUCUCAGAGCCUCUC | Chp | [692-710] 3'UTR | [966-984] 3'UTR | [683-701] 3'UTR |
| 103 | 5523 | ACCAGAGGCAGUAACCAUG | 5734 | CAUGGUUACUGCCUCUGGU | Chp | [621-639] ORF | [895-913] 3'UTR | [612-630] 3'UTR |
| 104 | 5524 | ACACUGCUAGCAAAUGGCA | 5735 | UGCCAUUUGCUAGCAGUGU | Chp | [1095-1113] 3'UTR | [1369-1387] 3'UTR | [1086-1104] 3'UTR |
| 105 | 5525 | CUUUUCACUGUGUUGGAGU | 5736 | ACUCCAACACAGUGAAAG | Chp | [932-950] 3'UTR | [1206-1224] 3'UTR | [923-941] 3'UTR |
| 106 | 5526 | ACCGCUUCUGCCUUUUCAC | 5737 | GUGAAAAGGCAGAAGCGGU | Chp | [921-939] 3'UTR | [1195-1213] 3'UTR | [912-930] 3'UTR |
| 107 | 5527 | CUUGAGUCACACUGCUAGC | 5738 | GCUAGCAGUGUGACUCAAG | Chp | [1087-1105] 3'UTR | [1361-1379] 3'UTR | [1078-1096] 3'UTR |
| 108 | 5528 | GUGAACUAGGGAAGCUCAG | 5739 | CUGAGCUUCCCUAGUUCAC | Chp | [1051-1069] 3'UTR | [1325-1343] 3'UTR | [1042-1060] 3'UTR |
| 109 | 5529 | AUGUGGGCAUUUCUUGCGA | 5740 | UCGCAAGAAAUGCCCACAU | | [988-1006] 3'UTR | [1262-1280] 3'UTR | [979-997] 3'UTR |
| 110 | 5530 | UUGGAGUUUUCUGGAGUGA | 5741 | UCACUCCAGAAAACUCCAA | | [944-962] 3'UTR | [1218-1236] 3'UTR | [935-953] 3'UTR |
| 111 | 5531 | UCACUGUGUUGGAGUUUUC | 5742 | GAAAACUCCAACACAGUGA | Chp | [936-954] 3'UTR | [1210-1228] 3'UTR | [927-945] 3'UTR |
| 112 | 5532 | AAAAAGAAAAACACCGCUU | 5743 | AAGCGGUGUUUUUCUUUUU | Chp | [909-927] 3'UTR | [1183-1201] 3'UTR | [900-918] 3'UTR |
| 113 | 5533 | CGUAGAUAUAUGCCUUCCC | 5744 | GGGAAGGCAUAUAUCUACG | | [835-853] 3'UTR | [1109-1127] 3'UTR | [826-844] 3'UTR |
| 114 | 5534 | AGAACCAGAGAGGCUCUGA | 5745 | UCAGAGCCUCUCUGGUUCU | | [685-703] 3'UTR | [959-977] 3'UTR | [676-694] 3'UTR |
| 115 | 5535 | CACUGCUAGCAAAUGGCAG | 5746 | CUGCCAUUUGCUAGCAGUG | Chp | [1096-1114] 3'UTR | [1370-1388] 3'UTR | [1087-1105] 3'UTR |
| 116 | 5536 | AAGCAUUUUGUGAACUAGG | 5747 | CCUAGUUCACAAAAUGCUU | | [1042-1060] 3'UTR | [1316-1334] 3'UTR | [1033-1051] 3'UTR |
| 117 | 5537 | UUUUAAAAAUGUCCUGCCU | 5748 | AGGCAGGACAUUUUUAAAA | | [811-829] 3'UTR | [1085-1103] 3'UTR | [802-820] 3'UTR |
| 118 | 5538 | CAGAGAGGCUCUGAGAAAC | 5749 | GUUUCUCAGAGCCUCUCUG | Chp | [690-708] 3'UTR | [964-982] 3'UTR | [681-699] 3'UTR |
| 119 | 5539 | AUUUCUUGCGAGCCUCGCA | 5750 | UGCGAGGCUCGCAAGAAAU | | [996-1014] 3'UTR | [1270-1288] 3'UTR | [987-1005] 3'UTR |
| 120 | 5540 | CCUUUUCACUGUGUUGGAG | 5751 | CUCCAACACAGUGAAAAGG | Chp | [931-949] 3'UTR | [1205-1223] 3'UTR | [922-940] 3'UTR |
| 121 | 5541 | GUCCUGCCUUUUAACGUAG | 5752 | CUACGUUAAAAGGCAGGAC | | [821-839] 3'UTR | [1095-1113] 3'UTR | [812-830] 3'UTR |
| 122 | 5542 | AUCAGUCACCGAAGGUCCU | 5753 | AGGACCUUCGGUGACUGAU | Chp | [726-744] 3'UTR | [1000-1018] 3'UTR | [717-735] 3'UTR |
| 123 | 5543 | AACCUCGGGAAACUUAGAU | 5754 | AUCUAAGUUUCCCGAGGUU | | [706-724] 3'UTR | [980-998] 3'UTR | [697-715] 3'UTR |
| 124 | 5544 | AACCAUGCCCGCAUAGAUG | 5755 | CAUCUAUGCGGGCAUGGUU | Chp | [633-651] ORF | [907-925] 3'UTR | [624-642] 3'UTR |
| 125 | 5545 | AGCUUUUAAAAAUGUCCUG | 5756 | CAGGACAUUUUUAAAAGCU | | [808-826] 3'UTR | [1082-1100] 3'UTR | [799-817] 3'UTR |
| 126 | 5546 | CUGGCUUCUCUUGAGUCAC | 5757 | GUGACUCAAGAGAAGCCAG | | [1078-1096] 3'UTR | [1352-1370] 3'UTR | [1069-1087] 3'UTR |
| 127 | 5547 | AAAACACCGCUUCUGCCUU | 5758 | AAGGCAGAAGCGGUGUUUU | Chp | [916-934] 3'UTR | [1190-1208] 3'UTR | [907-925] 3'UTR |
| 128 | 5548 | CAAAUGGCAGAACCAAAGC | 5759 | GCUUUGGUUCUGCCAUUUG | Chp | [1105-1123] 3'UTR | [1379-1397] 3'UTR | [1096-1114] 3'UTR |
| 129 | 5549 | UCUGCCUUUUCACUGUGUU | 5760 | AACACAGUGAAAAGGCAGA | Chp | [927-945] 3'UTR | [1201-1219] 3'UTR | [918-936] 3'UTR |
| 130 | 5550 | CCCACUACCGUAAAUGUCC | 5761 | GGACAUUUACGGUAGUGGG | | [853-871] 3'UTR | [1127-1145] 3'UTR | [844-862] 3'UTR |
| 131 | 5551 | GCUUUCGUAGUUUUCAUUU | 5762 | AAAUGAAAACUACGAAAGC | Chp | [780-798] 3'UTR | [1054-1072] 3'UTR | [771-789] 3'UTR |
| 132 | 5552 | AAAGAACCAGAGAGGCUCU | 5763 | AGAGCCUCUCUGGUUCUUU | | [683-701] 3'UTR | [957-975] 3'UTR | [674-692] 3'UTR |
| 133 | 5553 | GCUAGCAAAUGGCAGAACC | 5764 | GGUUCUGCCAUUUGCUAGC | Chp | [1100-1118] 3'UTR | [1374-1392] 3'UTR | [1091-1109] 3'UTR |
| 134 | 5554 | CUGCCUUUUCACUGUGUUG | 5765 | CAACACAGUGAAAAGGCAG | Chp | [928-946] 3'UTR | [1202-1220] 3'UTR | [919-937] 3'UTR |
| 135 | 5555 | AAAAGAAAAACACCGCUUC | 5766 | GAAGCGGUGUUUUUCUUUU | Chp | [910-928] 3'UTR | [1184-1202] 3'UTR | [901-919] 3'UTR |
| 136 | 5556 | GACAAGCAUUUUGUGAACU | 5767 | AGUUCACAAAAUGCUUGUC | | [1039-1057] 3'UTR | [1313-1331] 3'UTR | [1030-1048] 3'UTR |
| 137 | 5557 | UUUAAAAAUGUCCUGCCUU | 5768 | AAGGCAGGACAUUUUUAAA | | [812-830] 3'UTR | [1086-1104] 3'UTR | [803-821] 3'UTR |
| 138 | 5558 | UCAGUCACCGAAGGUCCUA | 5769 | UAGGACCUUCGGUGACUGA | Chp | [727-745] 3'UTR | [1001-1019] 3'UTR | [718-736] 3'UTR |
| 139 | 5559 | UGAAGAACCAGAGAGGCU | 5770 | AGCCUCUCUGGUUCUUUCA | Chp | [681-699] ORF+3'UTR | [955-973] 3'UTR | [672-690] 3'UTR |
| 140 | 5560 | UGUGGGCAUUUCUUGCGAG | 5771 | CUCGCAAGAAAUGCCCACA | | [989-1007] 3'UTR | [1263-1281] 3'UTR | [980-998] 3'UTR |
| 141 | 5561 | AGAGCUUUUAAAAAUGUCC | 5772 | GGACAUUUUUAAAAGCUCU | | [806-824] 3'UTR | [1080-1098] 3'UTR | [797-815] 3'UTR |
| 142 | 5562 | GUUUUCUGGAGUGAGCACU | 5773 | AGUGCUCACUCCAGAAAAC | Chp | [949-967] 3'UTR | [1223-1241] 3'UTR | [940-958] 3'UTR |
| 143 | 5563 | AACACCGCUUCUGCCUUUU | 5774 | AAAAGGCAGAAGCGGUGUU | Chp | [918-936] 3'UTR | [1192-1210] 3'UTR | [909-927] 3'UTR |
| 144 | 5564 | GAAAAACACCGCUUCUGCC | 5775 | GGCAGAAGCGGUGUUUUUC | Chp | [914-932] 3'UTR | [1188-1206] 3'UTR | [905-923] 3'UTR |
| 145 | 5565 | AUGUCCUGCCUUUUAACGU | 5776 | ACGUUAAAAGGCAGGACAU | | [819-837] 3'UTR | [1093-1111] 3'UTR | [810-828] 3'UTR |
| 146 | 5566 | AUUUGUGAACUAGGGAAG | 5777 | CUUCCCUAGUUCACAAAAU | | [1046-1064] 3'UTR | [1320-1338] 3'UTR | [1037-1055] 3'UTR |
| 147 | 5567 | GUCGACUUCAUGACAAGCA | 5778 | UGCUUGUCAUGAAGUCGAC | | [1028-1046] 3'UTR | [1302-1320] 3'UTR | [1019-1037] 3'UTR |
| 148 | 5568 | ACUGUGUUGGAGUUUUCUG | 5779 | CAGAAAACUCCAACACAGU | Chp | [938-956] 3'UTR | [1212-1230] 3'UTR | [929-947] 3'UTR |
| 149 | 5569 | UUCACUGUGUUGGAGUUUU | 5780 | AAAACUCCAACACAGUGAA | Chp | [935-953] 3'UTR | [1209-1227] 3'UTR | [926-944] 3'UTR |
| 150 | 5570 | UUGAGUCACACUGCUAGCA | 5781 | UGCUAGCAGUGUGACUCAA | Chp | [1088-1106] 3'UTR | [1362-1380] 3'UTR | [1079-1097] 3'UTR |

FIGURE 4 Continued

| # | ID | Seq1 | ID2 | Seq2 | Chp | Range1 | Range2 | Range3 |
|---|---|---|---|---|---|---|---|---|
| 151 | 5571 | ACUUCAUGACAAGCAUUUU | 5782 | AAAAUGCUUGUCAUGAAGU | | [1032-1050] 3'UTR | [1306-1324] 3'UTR | [1023-1041] 3'UTR |
| 152 | 5572 | GUAAAAAAGAAAAACACCG | 5783 | CGGUGUUUUCUUUUUUAC | Chp | [906-924] 3'UTR | [1180-1198] 3'UTR | [897-915] 3'UTR |
| 153 | 5573 | GAAAGAACCAGAGAGGCUC | 5784 | GAGCCUCUCUGGUUCUUUC | Chp | [682-700] ORF+3'UTR | [956-974] 3'UTR | [673-691] 3'UTR |
| 154 | 5574 | UUCAUGACAAGCAUUUUGU | 5785 | ACAAAAUGCUUGUCAUGAA | | [1034-1052] 3'UTR | [1308-1326] 3'UTR | [1025-1043] 3'UTR |
| 155 | 5575 | CUUCAUGACAAGCAUUUUG | 5786 | CAAAAUGCUUGUCAUGAAG | | [1033-1051] 3'UTR | [1307-1325] 3'UTR | [1024-1042] 3'UTR |
| 156 | 5576 | UUUCUGGAGUGAGCACUCA | 5787 | UGAGUGCUCACUCCAGAAA | Chp | [951-969] 3'UTR | [1225-1243] 3'UTR | [942-960] 3'UTR |
| 157 | 5577 | CUUCUGCCUUUUCACUGUG | 5788 | CACAGUGAAAAGGCAGAAG | Chp | [925-943] 3'UTR | [1199-1217] 3'UTR | [916-934] 3'UTR |
| 158 | 5578 | ACCUCGGGAAACUUAGAUC | 5789 | GAUCUAAGUUUCCCGAGGU | | [707-725] 3'UTR | [981-999] 3'UTR | [698-716] 3'UTR |
| 159 | 5579 | AGAAAAACACCGCUUCUGC | 5790 | GCAGAAGCGGUGUUUUUCU | | [913-931] 3'UTR | [1187-1205] 3'UTR | [904-922] 3'UTR |
| 160 | 5580 | UUAACGUAGAUAUAUGCCU | 5791 | AGGCAUAUAUCUACGUUAA | | [831-849] 3'UTR | [1105-1123] 3'UTR | [822-840] 3'UTR |
| 161 | 5581 | CUUAGAUCAUCAGUCACCG | 5792 | CGGUGACUGAUGAUCUAAG | Chp | [718-736] 3'UTR | [992-1010] 3'UTR | [709-727] 3'UTR |
| 162 | 5582 | AGAGGCUCUGAGAAACCUC | 5793 | GAGGUUUCUCAGAGCCUCU | Chp | [693-711] 3'UTR | [967-985] 3'UTR | [684-702] 3'UTR |
| 163 | 5583 | CACACUGCUAGCAAAUGGC | 5794 | GCCAUUUGCUAGCAGUGUG | Chp | [1094-1112] 3'UTR | [1368-1386] 3'UTR | [1085-1103] 3'UTR |
| 164 | 5584 | CACAUUCAUGUGGGCAUUU | 5795 | AAAUGCCCACAUGAAUGUG | | [981-999] 3'UTR | [1255-1273] 3'UTR | [972-990] 3'UTR |
| 165 | 5585 | AAGCGCACAUUCAUGUGGG | 5796 | CCCACAUGAAUGUGCGCUU | | [976-994] 3'UTR | [1250-1268] 3'UTR | [967-985] 3'UTR |
| 166 | 5586 | AAAAACACCGCUUCUGCCU | 5797 | AGGCAGAAGCGGUGUUUUU | | [915-933] 3'UTR | [1189-1207] 3'UTR | [906-924] 3'UTR |
| 167 | 5587 | AGUUUUCUGGAGUGAGCAC | 5798 | GUGCUCACUCCAGAAAACU | Chp | [948-966] 3'UTR | [1222-1240] 3'UTR | [939-957] 3'UTR |
| 168 | 5588 | UUCUGCCUUUUCACUGUGU | 5799 | ACACAGUGAAAAGGCAGAA | Chp | [926-944] 3'UTR | [1200-1218] 3'UTR | [917-935] 3'UTR |
| 169 | 5589 | CUUUUAAAAAUGUCCUGCC | 5800 | GGCAGGACAUUUUUAAAAG | | [810-828] 3'UTR | [1084-1102] 3'UTR | [801-819] 3'UTR |
| 170 | 5590 | AAAUGGCAGAACCAAAGCU | 5801 | AGCUUUGGUUCUGCCAUUU | Chp | [1106-1124] 3'UTR | [1380-1398] 3'UTR | [1097-1115] 3'UTR |
| 171 | 5591 | CGCUUCUGCCUUUUCACUG | 5802 | CAGUGAAAAGGCAGAAGCG | | [923-941] 3'UTR | [1197-1215] 3'UTR | [914-932] 3'UTR |
| 172 | 5592 | AGUAACCAUGCCCGCAUAG | 5803 | CUAUGCGGGCAUGGUUACU | Chp | [630-648] ORF | [904-922] 3'UTR | [621-639] 3'UTR |
| 173 | 5593 | UCAUGUGGGCAUUUCUUGC | 5804 | GCAAGAAAUGCCCACAUGA | | [986-1004] 3'UTR | [1260-1278] 3'UTR | [977-995] 3'UTR |
| 174 | 5594 | ACUACCGUAAAUGUCCAUU | 5805 | AAUGGACAUUUACGGUAGU | | [856-874] 3'UTR | [1130-1148] 3'UTR | [847-865] 3'UTR |
| 175 | 5595 | ACAUUCAUGUGGGCAUUUC | 5806 | GAAAUGCCCACAUGAAUGU | | [982-1000] 3'UTR | [1256-1274] 3'UTR | [973-991] 3'UTR |
| 176 | 5596 | CUUCUCUUGAGUCACACUG | 5807 | CAGUGUGACUCAAGAGAAG | Chp | [1082-1100] 3'UTR | [1356-1374] 3'UTR | [1073-1091] 3'UTR |
| 177 | 5597 | CUAAGCGCACAUUCAUGUG | 5808 | CACAUGAAUGUGCGCUUAG | | [974-992] 3'UTR | [1248-1266] 3'UTR | [965-983] 3'UTR |
| 178 | 5598 | ACACCGCUUCUGCCUUUUC | 5809 | GAAAAGGCAGAAGCGGUGU | Chp | [919-937] 3'UTR | [1193-1211] 3'UTR | [910-928] 3'UTR |
| 179 | 5599 | GCUUUUAAAAAUGUCCUGC | 5810 | GCAGGACAUUUUUAAAAGC | | [809-827] 3'UTR | [1083-1101] 3'UTR | [800-818] 3'UTR |
| 180 | 5600 | UCAUCAGUCACCGAAGGUC | 5811 | GACCUUCGGUGACUGAUGA | Chp | [724-742] 3'UTR | [998-1016] 3'UTR | [715-733] 3'UTR |
| 181 | 5601 | UGAACUAGGGAAGCUCAGG | 5812 | CCUGAGCUUCCCUAGUUCA | Chp | [1052-1070] 3'UTR | [1326-1344] 3'UTR | [1043-1061] 3'UTR |
| 182 | 5602 | UUCAUGUGGGCAUUUCUUG | 5813 | CAAGAAAUGCCCACAUGAA | | [985-1003] 3'UTR | [1259-1277] 3'UTR | [976-994] 3'UTR |
| 183 | 5603 | AACGUAGAUAUAUGCCUUC | 5814 | GAAGGCAUAUAUCUACGUU | | [833-851] 3'UTR | [1107-1125] 3'UTR | [824-842] 3'UTR |
| 184 | 5604 | AGAGAGGCUCUGAGAAACC | 5815 | GGUUUCUCAGAGCCUCUCU | | [691-709] 3'UTR | [965-983] 3'UTR | [682-700] 3'UTR |
| 185 | 5605 | AUCAUCAGUCACCGAAGGU | 5816 | ACCUUCGGUGACUGAUGAU | Chp | [723-741] 3'UTR | [997-1015] 3'UTR | [714-732] 3'UTR |
| 186 | 5606 | UUUGUGAACUAGGGAAGCU | 5817 | AGCUUCCCUAGUUCACAAA | Chp | [1048-1066] 3'UTR | [1322-1340] 3'UTR | [1039-1057] 3'UTR |
| 187 | 5607 | UUCUGGAGUGAGCACUCAC | 5818 | GUGAGUGCUCACUCCAGAA | Chp | [952-970] 3'UTR | [1226-1244] 3'UTR | [943-961] 3'UTR |
| 188 | 5608 | AACUAGAUCAUCAGUCAC | 5819 | GUGACUGAUGAUCUAAGUU | Chp | [716-734] 3'UTR | [990-1008] 3'UTR | [707-725] 3'UTR |
| 189 | 5609 | UUCUCUUGAGUCACACUGC | 5820 | GCAGUGUGACUCAAGAGAA | Chp | [1083-1101] 3'UTR | [1357-1375] 3'UTR | [1074-1092] 3'UTR |
| 190 | 5610 | UUUUGUGAACUAGGGAAGC | 5821 | GCUUCCCUAGUUCACAAAA | Chp | [1047-1065] 3'UTR | [1321-1339] 3'UTR | [1038-1056] 3'UTR |
| 191 | 5611 | AUUGAAAGAACCAGAGAGG | 5822 | CCUCUCUGGUUCUUUCAAU | Chp | [679-697] ORF+3'UTR | [953-971] 3'UTR | [670-688] 3'UTR |
| 192 | 5612 | AAGCUGUCGACUUCAUGAC | 5823 | GUCAUGAAGUCGACAGCUU | Chp | [1023-1041] 3'UTR | [1297-1315] 3'UTR | [1014-1032] 3'UTR |
| 193 | 5613 | UAAAAAAGAAAAACACCGC | 5824 | GCGGUGUUUUCUUUUUUA | Chp | [907-925] 3'UTR | [1181-1199] 3'UTR | [898-916] 3'UTR |
| 194 | 5614 | UACUGGCUUCUCUUGAGUC | 5825 | GACUCAAGAGAAGCCAGUA | Chp | [1076-1094] 3'UTR | [1350-1368] 3'UTR | [1067-1085] 3'UTR |
| 195 | 5615 | ACGUAGAUAUAUGCCUUCC | 5826 | GGAAGGCAUAUAUCUACGU | Chp | [834-852] 3'UTR | [1108-1126] 3'UTR | [825-843] 3'UTR |
| 196 | 5616 | UUUCACUGUGUUGGGAUUU | 5827 | AAACUCCAACACAGUGAAA | Chp | [934-952] 3'UTR | [1208-1226] 3'UTR | [925-943] 3'UTR |
| 197 | 5617 | AAUGUCCUGCCUUUUAACG | 5828 | CGUUAAAAGGCAGGACAUU | | [818-836] 3'UTR | [1092-1110] 3'UTR | [809-827] 3'UTR |
| 198 | 5618 | UUUUCUGGAGUGAGCACUC | 5829 | GAGUGCUCACUCCAGAAAA | Chp | [950-968] 3'UTR | [1224-1242] 3'UTR | [941-959] 3'UTR |
| 199 | 5619 | UGUCGACUUCAUGACAAGC | 5830 | GCUUGUCAUGAAGUCGACA | | [1027-1045] 3'UTR | [1301-1319] 3'UTR | [1018-1036] 3'UTR |
| 200 | 5620 | CAUGUGGGCAUUUCUUGCG | 5831 | CGCAAGAAAUGCCCACAUG | | [987-1005] 3'UTR | [1261-1279] 3'UTR | [978-996] 3'UTR |
| 201 | 5621 | AAGAAAAACACCGCUUCUG | 5832 | CAGAAGCGGUGUUUUUCUU | Chp | [912-930] 3'UTR | [1186-1204] 3'UTR | [903-921] 3'UTR |
| 202 | 5622 | UUGUGAACUAGGGAAGCUC | 5833 | GAGCUUCCCUAGUUCACAA | Chp | [1049-1067] 3'UTR | [1323-1341] 3'UTR | [1040-1058] 3'UTR |
| 203 | 5623 | UGCUAGCAAAUGGCAGAAC | 5834 | GUUCUGCCAUUUGCUAGCA | Chp | [1099-1117] 3'UTR | [1373-1391] 3'UTR | [1090-1108] 3'UTR |
| 204 | 5624 | ACUUAGAUCAUCAGUCACC | 5835 | GGUGACUGAUGAUCUAAGU | Chp | [717-735] 3'UTR | [991-1009] 3'UTR | [708-726] 3'UTR |
| 205 | 5625 | GUCACACUGCUAGCAAAUG | 5836 | CAUUUGCUAGCAGUGUGAC | Chp | [1092-1110] 3'UTR | [1366-1384] 3'UTR | [1083-1101] 3'UTR |
| 206 | 5626 | AAUGGCAGAACCAAAGCUC | 5837 | GAGCUUUGGUUCUGCCAUU | Chp | [1107-1125] 3'UTR | [1381-1399] 3'UTR | [1098-1116] 3'UTR |
| 207 | 5627 | AAGAACCAGAGAGGCUCUG | 5838 | CAGAGCCUCUCUGGUUCUU | Chp | [684-702] 3'UTR | [958-976] 3'UTR | [875-693] 3'UTR |

FIGURE 4 Continued

| 208 | 5628 | UUGAAAGAACCAGAGAGGC | 5839 | GCCUCUCUGGUUCUUUCAA | Chp | [680-698] ORF+3'UTR | [954-972] 3'UTR | [871-689] 3'UTR |
|---|---|---|---|---|---|---|---|---|
| 209 | 5629 | UGCCUUUUCACUGUGUUGG | 5840 | CCAACACAGUGAAAAGGCA | Chp | [929-947] 3'UTR | [1203-1221] 3'UTR | [920-938] 3'UTR |
| 210 | 5630 | UAAGCGCACAUUCAUGUGG | 5841 | CCACAUGAAUGUGCGCUUA | | [975-993] 3'UTR | [1249-1267] 3'UTR | [966-984] 3'UTR |
| 211 | 5631 | UUUAACGUAGAUAUAUGCC | 5842 | GGCAUAUAUCUACGUUAAA | Chp | [830-848] 3'UTR | [1104-1122] 3'UTR | [821-839] 3'UTR |

COMPOSITIONS AND METHODS FOR TREATMENT OF EAR DISORDERS

This application is a §371 national stage of PCT International Application No. PCT/IL2009/000570, filed Jun. 7, 2009, and claims the benefit of U.S. Provisional Application No. 61/131,162, filed Jun. 6, 2008, which are hereby incorporated by reference in their entirety.

This application incorporates-by-reference nucleotide and/or amino acid sequences which are present in the file named "120701_2094_79459_A_PCT_US_SubstituteSequenceListing.txt" which is 1,171 kB in size, and which was created Jul. 1, 2012 and which is contained in the text file filed Jul. 24, 2012.

FIELD OF THE INVENTION

The present invention relates to otic compositions and methods for delivery of an oligonucleotide compound, including siRNA, to the middle and inner ear useful in the treatment of an ear disorder, including hearing loss resulting from chemical-induced ototoxicity, acoustic trauma and presbycusis; tumors and microbial infections.

BACKGROUND OF THE INVENTION

The Human Ear

The ear is comprised of three major structural components: the outer, middle, and inner ears, which function together to convert sound waves into nerve impulses that travel to the brain, where they are perceived as sound. The inner ear also helps to maintain balance.

The anatomy of the middle and the inner ear is well known to those of ordinary skill in the art (see, e.g., *Atlas of Sensory Organs: Functional and Clinical Analysis*, Andrs Csillag, Humana Press (2005), pages 1-82, incorporated herein by reference). In brief, the middle ear consists of the eardrum and a small air-filled chamber containing a sequence of three tiny bones known as the ossicles, which link the eardrum to the inner ear.

The inner ear (labyrinth) is a complex structure consisting of the cochlea, which is the organ of hearing and the vestibular system, the organ of balance. The vestibular system consists of the saccule and the utricle, which determine position sense, and the semicircular canals, which help maintain balance.

The cochlea houses the organ of Corti, which consists, in part, of about 20,000 specialized sensory cells, called "inner ear hair cells" or "hair cells". These cells have small hairline projections (cilia) that extend into the cochlear fluid. Sound vibrations transmitted from the ossicles in the middle ear to the oval window in the inner ear cause the fluid and cilia to vibrate. Hair cells in different parts of the cochlea vibrate in response to different sound frequencies and convert the vibrations into nerve impulses which are sent to the brain for processing and interpretation. The inner ear hair cells are surrounded by inner ear support cells. Supporting cells underlie, at least partially surround, and physically support sensory hair cells within the inner ear. Representative examples of support cells include inner rod (pillar cells), outer rod (pillar cells), inner phalangeal cells, outer phalangeal cells (of Deiters), cells of Held, cells of Hensen, cells of Claudius, cells of Boettcher, interdental cells and auditory teeth (of Huschke).

The spiral ganglion is the group of nerve cells that send a representation of sound from the cochlea to the brain. The cell bodies of the spiral ganglion neurons are found in the spiral structure of the cochlea and are part of the central nervous system. Their dendrites make synaptic contact with the base of hair cells, and their axons are bundled together to form the auditory portion of the eighth cranial nerve (vestibulocochlear nerve).

Hearing Loss

Despite the protective effect of the acoustic reflex, loud noise can damage and destroy hair cells. Irreversible hair cell death is elicited by metabolic or biochemical changes in the hair cells that involve reactive oxygen species (ROS). Exposure to certain drugs and continued exposure to loud noise, inter alia, cause progressive damage, eventually resulting in ringing in the ears (tinnitus) and or hearing loss.

Acquired hearing loss can be caused by several factors including exposure to harmful noise levels, exposure to ototoxic drugs such as cisplatin and aminoglycoside antibiotics and aging.

International Patent Publication No. WO 2008/050329 to the assignee of the present invention relates to siRNA compounds, compositions comprising same and to methods of use thereof for treating diseases and disorders related to expression of proapoptotic genes. U.S. Ser. No. 11/655,610 to the assignee of the present invention relates to methods of treating hearing impairment by inhibiting a pro-apoptotic gene in general and p53 in particular. International Patent Publication No. WO 2005/119251 relates to methods of treating deafness. International Patent Publication No. WO/2005/055921 relates to foam compositions for treatment of ear disorders. U.S. Pat. No. 7,087,581 relates to methods of treating diseases and disorders of the inner ear.

There remains a genuine need for easy to use, high compliance pharmaceutical therapies, which effect, inter alia, otoprotection, chemoprotection and hearing regeneration.

SUMMARY OF THE INVENTION

The present invention provides pharmaceutical compositions and methods useful in treating an ear disorder, including middle ear and inner ear disorders. The present invention overcomes certain of the limitations in the prior art by providing a non-invasive method of treating an ear disorder comprising topically administering an oligonucleotide to a target gene, wherein the inhibitory oligonucleotide is formulated for topical, non-invasive application. This method is surprising in view of the size of an oligonucleotide and in view of the use of transtympanic injection for delivery of oligonucleotides heretofore. This method also overcomes the limitations associated with use of oral therapeutics, which are often associated with adverse systemic side effects.

According to one aspect, the present invention provides a method of treating a subject suffering from or at risk of an ear disorder which comprises topically administering to the canal of the subject's ear a pharmaceutical composition comprising an oligonucleotide inhibitor, a permeability enhancer and a pharmaceutically acceptable excipient or mixtures thereof, thereby reducing expression of a gene associated with the disorder in the ear of the subject in an amount effective to treat the subject.

In various embodiments the permeability enhancer is a polyol. In some embodiments the oligonucleotide is in admixture with a polyol. In some embodiments the polyol is selected from glycerol, propylene glycol, polyethylene glycol, sorbitol, xylitol, or maltitol. According to one embodiment the polyol is glycerol. In various embodiments glycerol is present at a final concentration of about 0.1% to about 35%; about 1% to about 30%; about 5% to about 25%, preferably about 10% to about 20%. In some embodiments the final concentration of glycerol in the pharmaceutical composition is about 2.5%, 5%, 10%, 12.5%, 15%, 17.5%, 20%, 22.5%, 25%, 27.5% or about 30%. In one preferred embodiment, the final concentration of glycerol in the pharmaceutical composition is about 10%. In some embodiments the pharmaceutical composition is brought to the subject's body temperature, which is about 35° C.-38° C., prior to application to the ear.

In some embodiments, the pharmaceutical composition is applied to the ear canal when the subject's head is tilted to one side and the treated ear is facing upward. In some embodiments, the pharmaceutical composition is applied to the ear using a receptacle for eardrops, for example using a dropper of for example, 10-100 microliter per drop, or a wick.

In some embodiments an ear disorder relates to chemical-induced hearing loss; for example hearing loss induced by inter alia cisplatin and its analogs; aminoglycoside antibiotics, quinine and its analogs; salicylate and its analogs; phosphodiesterase type 5 (PDE5) inhibitors or loop-diuretics. In some embodiments the ear disorder refers to noise-induced hearing loss. In other embodiments the ear disorder is age related hearing loss.

In various embodiments the pharmaceutical composition is formulated as eardrops, ear cream, ear ointment, ear foam or mousse. In certain preferred embodiments the pharmaceutical composition is formulated as eardrops. In some embodiments the method comprising unilateral administration of an oligonucleotide to a subject's ear.

In some embodiments the oligonucleotide is an inhibitory nucleic acid compound selected from the group consisting of an antisense, a siRNA, a shRNA, an aptamer, a ribozyme, a dsRNA or DNA compound. In various preferred embodiment the oligonucleotide is siRNA.

In another embodiment the oligonucleotide comprises a sufficient number of consecutive nucleotides having a sequence of sufficient homology to a nucleic acid sequence present within a target gene to reduce or inhibit expression of the gene in the subject. In certain embodiments the siRNA is chemically synthesized and chemically modified. The modifications comprise base modifications, sugar modifications, internucleotide linkage modifications or combinations thereof.

In one embodiment the method and composition for the present invention utilize a siRNA compound having the following structure:

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present;

wherein 1' may be present or absent, but if present is a capping moiety covalently attached at the 5' terminus of (N')y;

wherein each of x and y is independently an integer between 18 and 40:

wherein the sequence of (N')y is substantially complementary to the sequence of (N)x; and wherein (N)x comprises an antisense sequence (N)x comprises an antisense sequence substantially complementary to from about 18 to about 40 consecutive ribonucleotides in an mRNA of a target gene associated with an ear disorder.

In various embodiments (N)x comprises 2'-O-methyl (2'OMe) modified and unmodified ribonucleotides, wherein N at the 3' terminus of (N)x is a 2'OMe modified ribonucleotide, (N)x comprises at least five alternating 2'OMe modified ribonucleotides beginning at the 3' end and at least nine 2'OMe modified ribonucleotides in total and each remaining N is an unmodified ribonucleotide and (N')y comprises at least one mirror nucleotide, or a nucleotide joined to an adjacent nucleotide by a 2'-5' internucleotide phosphate bond.

In additional embodiments (N)x comprises modified ribonucleotides in alternating positions wherein each N at the 5' and 3' termini are modified in their sugar residues and the middle ribonucleotide is not modified, e.g. ribonucleotide in position 10 in a 19-mer strand. In various embodiments in (N)x and (N')y the nucleotides alternate between 2'OMe sugar modified ribonucleotides and unmodified ribonucleotides. In some embodiments the ribonucleotide located at the middle position of (N)x is unmodified and the ribonucleotide located at the middle position of (N')y is 2'OMe sugar modified.

For all the structures, in some embodiments the covalent bond joining each consecutive N or N' is a phosphodiester bond. In various embodiments all the covalent bonds are phosphodiester bonds.

In various embodiments x=y and each of x and y is 19, 20, 21, 22 or 23. In some embodiments x=y=21. In other embodiments x=y=19.

In one embodiment of the above structure, (N')y comprises at least one mirror nucleotide at one terminus or both termini or in a penultimate position. In various embodiments (N')y comprises one mirror nucleotide at the 3' penultimate position. In one preferred embodiment x=y=19 and (N')y comprises an L-deoxyribonucleotide at position 18. In one embodiment, a siRNA compound of the invention inhibits the expression of a target gene selected from a viral gene, a bacterial gene and a mammalian gene associated with a disorder in the inner ear of a subject. In some embodiments the target gene is a mammalian gene wherein the gi number of the mRNA of the target gene is set forth in Table 1.

In certain embodiments the target gene is selected from one or more of the group consisting of: TP53BP2 (ASPP2), BNIP3, CASP2, NOX3, HRK, RAC1, DDIT4 (REDD1), DDIT4L (REDD2), NOX4, HTRA2, CAPNS1 (Calpain), ID3, HES1, HES5, and CDKN1B (p27KIP).

For convenience and without wishing to be bound to theory the target genes are classified into two groups: Group I target genes relate to otoprotection and include TP53BP2 (ASPP2), BNIP3, CASP2, NOX3, HRK, RAC1, DDIT4 (REDD1), DDIT4L (REDD2), NOX4. HTRA2, CAPNS1 (Calpain), ID3 and Group II target genes relate to cellular regeneration and proliferation and include ID3. HES1, HES5, and CDKN1B (p27KIP).

According to various embodiments, the method of the present invention provides for inhibiting more than one target gene associated with the ear disorder using one or more oligonucleotides of the invention.

Accordingly, in one embodiment, the method of the invention is directed treating a subject suffering from an ear disorder by inhibiting two or more target genes designated herein as Group I target genes. In a non-limiting example a siRNA compound to each of the following target genes is administered to a subject: at least one of TP53BP2 (ASPP2), CASP2 and HTRA2, optionally in combination with CAPNS1 (Calpain), optionally in combination with at least one of NOX3, NOX4 and RAC1, optionally in combination with at least one of DDIT4, DDIT4L and ID3, and optionally in combination with at least one of HRK and BNIP3. Without being bound by theory, inhibition of at least one these target genes is associated with the protection against ototoxin-induced hearing loss.

In another embodiment, the method of the invention is directed to treating a subject suffering from an ear disorder by inhibiting two or more target genes designated herein as Group II: at least one of CDKN1B and ID3, optionally in combination with at least one of HES1 and HES5. Without being bound by theory, the inhibition of at least one of these target genes is associated with the promotion of proliferation of supporting cells or outer or inner hair cells in the cochlea.

In a preferred embodiment, the method comprises administering the oligonucleotides directed against at least one of CDKN1B and ID3 prior to administering the oligonucleotides directed against at least one of HES1 and HES5. In another embodiment, all oligonucleotides are administered together.

In a further embodiment, an oligonucleotide directed against a target gene in one group is administered sequentially to an oligonucleotide directed against a target gene in the other group. For example, a siRNA that targets a group I gene is administered to a subject before administration of a siRNA that targets a group II gene. In another embodiment, a siRNA directed against a group I gene is administered to a subject together with a siRNA directed against a group II gene. In various embodiments the target gene is a mammalian gene. In certain embodiments the mammalian gene is a human gene wherein the gi number for the mRNA of the human gene is set forth in Table 1.

In a second aspect the present invention provides an otic pharmaceutical composition comprising: (a) a therapeutically effective amount of at least one an oligonucleotide molecule compound which inhibits the expression of a human target gene associated with an ear disorder in the inner ear or middle ear (b) a permeability enhancer; and (c) at least one pharmaceutically acceptable excipient or carrier, or mixtures thereof. In some embodiments the permeability enhancer is a polyol selected from the group consisting of glycerol, propylene glycol, sorbitol, xylitol and maltitol.

In preferred embodiments the polyol is glycerol. In various embodiments glycerol is present at a final concentration of about 0.1% to about 35%; about 1% to about 30%; about 5% to about 25%, about 7% to about 15%, preferably about 10% to about 20%. In some embodiments the final concentration of glycerol in the pharmaceutical composition is about 2.5%, 5%, 10%, 12.5%, 15%, 17.5%, 20%, 22.5%, 25%, 27.5% or about 30%. In one preferred embodiment, the final concentration of glycerol in the pharmaceutical composition is about 10%.

In some embodiments the composition is formulated for non-invasive application to the human ear, preferably to the ear canal. In various embodiments the composition is formulated as a cream, a foam, a mousse, a paste, an ointment, an emulsion, a solution, a gel, a spray, a suspension, a microemulsion, microspheres, microcapsules, nanospheres, nanoparticles, lipid vesicles, liposomes, polymeric vesicles, patches, a biological insert.

In various embodiments the pharmaceutical composition is formulated as liquid eardrops, ear cream, ear ointment, ear foam or mousse. In preferred embodiments the pharmaceutical composition is formulated as liquid eardrops.

In some embodiments the oligonucleotide is an inhibitory nucleic acid compound selected from the group consisting of an antisense, an unmodified siRNA, a chemically modified siRNA, an shRNA, an aptamer, a ribozyme, a dsRNA or DNA compound. In various preferred embodiment the oligonucleotide is siRNA.

In various embodiments the siRNA is chemically modified to increase stability, increase activity, reduce off target effects, and or to reduce innate immune stimulation. The concentration of siRNA in the composition is between 0.1 mg/ml to 100 mg/ml, preferably between 1 mg/ml to 100 mg/ml, and more preferably between 5 mg/ml to 20 mg/ml.

In a preferred embodiment, the target gene is selected from one or more of: TP53BP2 (ASPP2), BNIP3, CASP2, NOX3, HRK, RAC1, DDIT4, DDIT4L, NOX4, HTRA2, CAPNS1 (Calpain), ID3, HES1, HES5, CDKN1B and ID3.

In some embodiments the oligonucleotide reduces or inhibits expression of a gene associated with a middle ear disorder or an inner ear disorder.

In some embodiments the pharmaceutical composition according to the present invention comprises a chemically modified siRNA compound comprising one of Structures (A)-(P) disclosed herein.

BRIEF DESCRIPTION OF THE FIGURES

FIG. 4. provides Tables A1-A7 which set forth antisense and sense sequences useful in the preparation of siRNA compounds to certain target genes useful in practicing the present invention. In Table A1: HES1—hairy and enhancer of split 1, the sense strands of siRNA numbered 1-412 have SEQ ID NOS: 37-448, respectively, and the antisense strands of siRNAs numbered 1-412 have SEQ ID NOS: 449-860, respectively. In Table A1(a), the sense strands of siRNA numbered 262-644 have SEQ ID NOS: 861-1,243, respectively, and the antisense strands of siRNAs numbered 262-644 have SEQ ID NOS: 1,244-1,626, respectively. In Table A2 HES5—hairy and enhancer split 5, the sense strands of siRNA numbered 1-257 have SEQ ID NOS: 1,627-1,883, respectively, and the antisense strands of siRNAs numbered 1-257 have SEQ ID NOS: 1,884-2,140, respectively. In Table A3 ID1—inhibitor of DNA binding 1, the sense strands of siRNA numbered 1-283 have SEQ ID NOS: 2,141-2,423, respectively and the antisense strands of siRNAs numbered 1-283 have SEQ ID NOS: 2,424-2,706, respectively. In Table A4 ID2—inhibitor of DNA binding 2, the sense strands of siRNA numbered 1-500 have SEQ ID NOS: 2,707-3,206, respectively, and the antisense strands of siRNAs numbered 1-500 have SEQ ID NOS: 3,207-3,706, respectively. In Table A5 ID3—inhibitor of DNA binding 3, the sense strands of siRNA numbered 1-357 have SEQ ID NOS: 3,707-4,063, respectively, and the antisense strands of siRNAs numbered 1-357 have SEQ ID NOS: 4,064-4,420, respectively. In Table A6 CDKN1B—cyclin-dependent kinase inhibitor 1B (p27, Kip1), the sense strands of siRNA numbered 1-500 have SEQ ID NOS: 4,421-4,920, respectively, and the antisense strands of siRNAs numbered 1-500 have SEQ ID NOS: 4,921-5,420, respectively. In Table A7 CDKN2A —cyclin-dependent kinase inhibitor 2A (melanoma, p16, inhibits CDK4), the sense strands of siRNA numbered 1-211 have SEQ ID NOS: 5,421-5,631, respectively, and the antisense strands of siRNAs numbered 1-211 have SEQ ID NOS: 5,632-5,842, respectively.

DETAILED DESCRIPTION OF THE PRESENT INVENTION

Figure 1:
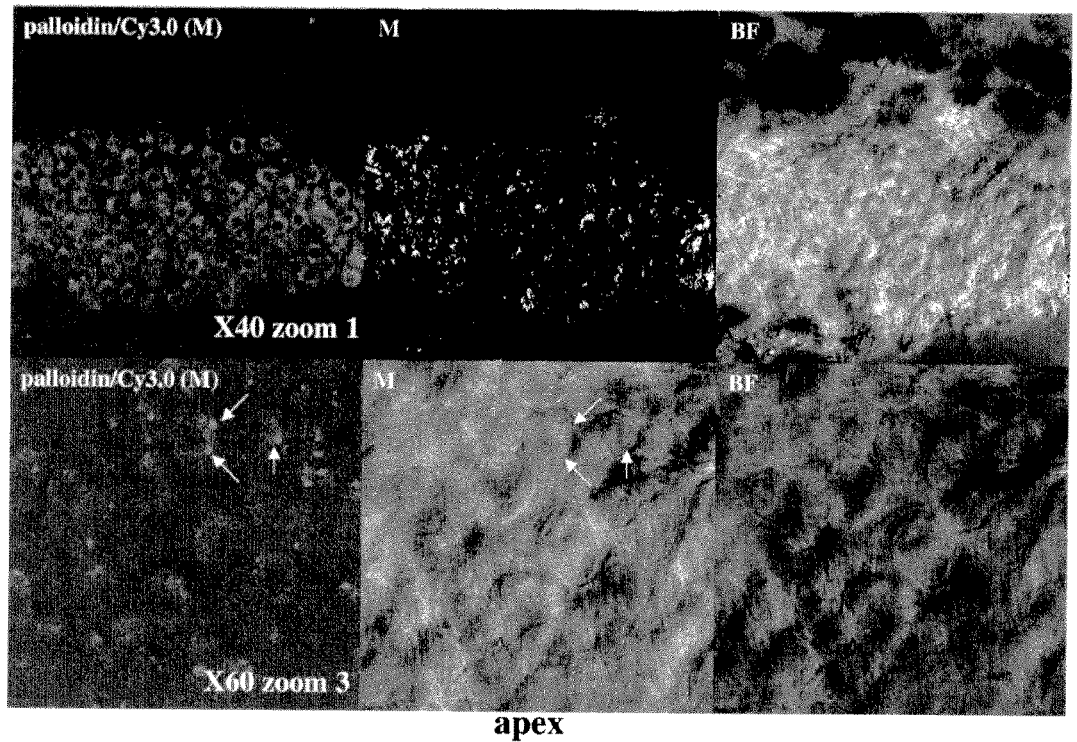
FIG. 1. Cy3 labelled DDIT4 siRNA in spiral ganglion (ganglion of Corti) in the apical turn of the organ of Corti, 3 days after application of eardrops.

The present invention relates in general to compositions and to methods useful in the treatment if middle and inner ear disorders.

Methods, molecules and compositions, which inhibit the genes of the invention, are discussed herein at length, and any of said molecules and/or compositions may be beneficially employed in the treatment of a subject suffering from any of said conditions.

The inhibitory nucleic acids of the present invention are preferably siRNA compounds that possess modifications which may increase activity, increase stability, and/or minimize toxicity when compared to the unmodified compound. These compounds, when admixed with a pharmaceutical vehicle that effects delivery of the nucleic acid to the middle and inner ear, provide effective, safe and patient compliant therapeutic compounds useful in treating a variety of ear disorders. The compounds are designed to prevent or attenuate target gene expression associated with the ear disorder. In certain embodiment the target gene is transcribed into any one of the mRNA polynucleotides set forth in Table 1. In a preferred embodiment, the target gene is selected from one or more of: TP53BP2 (ASPP2), BNIP3, CASP2, NOX3, HRK, RAC1, DDIT4, DDIT4L, NOX4, HTRA2, CAPNS1 (Calpain), ID3, HES1, HES5, CDKN1B.

Without wishing to be bound to theory the target genes are classified in two groups, group I directed to genes associated with otoprotection and include TP53BP2 (ASPP2), BNIP3, CASP2, NOX3, HRK, RAC1, DDIT4, DD1T4L, NOX4, HTRA2, CAPNS1 (Calpain), ID3, and group II associated with regeneration in cells of the inner ear and include ID3, HES1, HES5, CDKN1B. For some of the genes there is no clear group delineation and the grouping is provided for convenience only.

Details of several target genes are presented in Table 1, hereinbelow. This list is intended to be representative and non-limiting.

TABLE 1

Non-limiting example of human target genes for treating hearing loss

| No. | Gene | Full name and Human Gene ID |
|---|---|---|
| 1 | TP53BP2 | tumor protein p53 binding protein, 2<br>gi\|112799848\|ref\|NM_001031685.2 (SEQ ID NO: 1)<br>gi\|112799845\|ref\|NM_005426.2 (SEQ ID NO: 2) |
| 2 | LRDD | leucine-rich repeats and death domain containing<br>gi\|61742781\|ref\|NM_018494.3 (SEQ ID NO: 3)<br>gi\|61742783\|ref\|NM_145886.2 (SEQ ID NO: 4)<br>gi\|61742785\|ref\|NM_145887.2 (SEQ ID NO: 5) |
| 3 | CYBA | cytochrome b-245. alpha polypeptide<br>gi\|68509913\|ref\|NM_000101.2\| (SEQ. ID NO: 6) |
| 4 | p53 | tumor protein p53<br>gi8400737, NM_000546.2 (SEQ ID NO: 7) |
| 5 | CASP2 | caspase 2, apoptosis-related cysteine peptidase<br>gi\|39995058\|ref\|NM_032982.2 (SEQ ID NO: 8)<br>gi\|39995060\|ref\|NM_032983.2 (SEQ ID NO: 9) |
| 6 | NOX3 | NADPH oxidase 3<br>gi\|11136625\|ref\|NM_015718.1 (SEQ ID NO: 10) |
| 7 | HRK | harakiri<br>gi\|4504492\|ref\|NM_003806.1 (SEQ ID NO: 11) |
| 8 | CAPNS1 | Calpain small subunit 1<br>gi\|51599152\|ref\|NM_001749.2\| (SEQ ID NO: 12)<br>gi\|51599150\|ref\|NM_001003962.1\| (SEQ ID NO: 13) |
| 9 | RTP801 | Redd1; DNA-damage-inducible transcript 4<br>gi\|56676369\|ref\|NM_019058.2\| (SEQ ID NO: 14) |
| 10 | RTP801L | Redd2; DNA-damage-inducible transcript 4-like<br>gi\|34222182\|ref\|NM_145244.2\| (SEQ ID NO: 15) |
| 11 | Notch1 | Notch homolog 1, translocation-associated (Drosophila)<br>gi\|148833507\|ref\|NM_017617.3\| (SEQ ID NO: 16) |
| 12 | Rac1 | ras-related C3 botulinum toxin substrate 1<br>(rho family, small GTP binding protein)<br>gi\|38505164\|ref\|NM_198829.1 (SEQ ID NO: 17)<br>gi\|156071511\|ref\|NM_018890.3 (SEQ ID NO: 18)<br>gi\|156071503\|ref\|NM_006908.4 (SEQ ID NO: 19) |
| 13 | HES1 | hairy and enhancer of split 1, (Drosophila)<br>gi\|8400709\|ref\|NM__005524.2\| (SEQ ID NO: 20) |
| 14 | HES5 | hairy and enhancer of split 5 (Drosophila)<br>gi\|145301612\|ref\|NM_001010926.2\| (SEQ ID NO: 21) |

TABLE 1-continued

Non-limiting example of human target genes for treating hearing loss

| No. | Gene | Full name and Human Gene ID |
|---|---|---|
| 15 | ID1 | inhibitor of DNA binding 1, dominant negative helix-loop-helix protein<br>gi\|31317298\|ref\|NM_002165.2\| transcript variant 1 (SEQ ID NO: 22)<br>gi\|31317296\|ref\|NM_181353.1\| transcript variant 2 (SEQ ID NO: 23) |
| 16 | ID2 | inhibitor of DNA binding 2, dominant negative helix-loop-helix protein gi\|33946335\|ref\|NM_002166.4\| (SEQ ID NO:24) |
| 17 | ID3 | inhibitor of DNA binding 3, dominant negative helix-loop-helix protein gi\|156119620\|ref\|NM_002167.3\| (SEQ ID NO: 25) |
| 18 | CDKN1B | cyclin-dependent kinase inhibitor 1B (p27, Kip1)<br>gi\|17978497\|ref\|NM_004064.2\| (SEQ ID NO: 26) |
| 19 | CDKN2A | cyclin-dependent kinase inhibitor 2A (melanoma, p16, inhibits CDK4)<br>gi\|47132605\|ref\|NM_058195.2\| transcript variant 4 (SEQ ID NO: 27)<br>gi\|98985803\|ref\|NM_058197.3\| transcript variant 3 (SEQ ID NO: 28)<br>gi\|47132606\|ref\|NM_000077.3\| transcript variant 1 (SEQ ID NO: 29) |
| 20 | HTRA2 | Htra serine peptidase 2<br>var 1 gi:73747817\|ref\|NM_013247 (SEQ ID NO: 30)<br>var 2 gi:73747818\|ref\|NM_145074 (SEQ ID NO: 31) |
| 21 | KEAP1 | Kelch-like ECH-associated protein 1<br>var 1 gi:45269144\|ref\|NM_203500 (SEQ ID NO: 32)<br>var 2 gi:45269143\|ref\|NM_012289 (SEQ ID NO: 33) |
| 22 | SHC1 | Src homology 2 domain containing) transforming prot. 1<br>var 1 gi:52693920\|ref\|NM_183001 (SEQ ID NO: 34)<br>var 2 gi:34147725\|ref\|NM_003029 (SEQ ID NO: 35) |
| 23 | ZNHIT1 | Zn finger HIT type 1<br>gi:37594439\|ref\|NM_006349 (SEQ ID NO: 36) |

Table 1 provides the gi (GeneInfo identifier) and accession numbers for polynucleotide sequences of the mRNA for certain target genes set forth above.

Ear Disorders

The present invention is directed to compositions and methods useful in treating a patient suffering from or at risk of various ear disorders. Ear disorders include hearing loss induced for example by ototoxins, excessive noise or ageing. Middle and inner ear disorders produce many of the same symptoms, and a disorder of the middle ear may affect the inner ear and vice versa.

In addition to hearing loss, ear disorders include Myringitis, an eardrum infection caused by a variety of viruses and bacteria; Temporal bone fracture for example due to a blow to the head; Auditory nerve tumors (acoustic neuroma, acoustic neurinoma, vestibular schwannoma, eighth nerve tumor).

In various embodiments, the methods and compositions of the invention are useful in treating various conditions of hearing loss. Without being bound by theory, the hearing loss may be due to apoptotic inner ear hair cell damage or loss (Zhang et al., Neuroscience 2003. 120:191-205; Wang et al., J. Neuroscience 23((24):8596-8607), wherein the damage or loss is caused by infection, mechanical injury, loud sound (noise), aging (presbycusis), or chemical-induced ototoxicity.

By "ototoxin" in the context of the present invention is meant a substance that through its chemical action injures, impairs or inhibits the activity of the sound receptors component of the nervous system related to hearing, which in turn impairs hearing (and/or balance). In the context of the present invention, ototoxicity includes a deleterious effect on the inner ear hair cells. Ototoxins include therapeutic drugs including antineoplastic agents, salicylates, loop-diuretics, quinines, and aminoglycoside antibiotics, contaminants in foods or medicinals, and environmental or industrial pollutants. Typically, treatment is performed to prevent or reduce ototoxicity, especially resulting from or expected to result from administration of therapeutic drugs. Preferably a composition comprising therapeutically effective amount of a chemically modified siRNA compound of the invention is given immediately after the exposure to prevent or reduce the ototoxic effect. More preferably, treatment is provided prophylactically, either by administration of the pharmaceutical composition of the invention prior to or concomitantly with the ototoxic pharmaceutical or the exposure to the ototoxin.

Incorporated herein by reference are chapters 196, 197, 198 and 199 of The Merck Manual of Diagnosis and Therapy, 14th Edition, (1982), Merck Sharp & Dome Research Laboratories, N.J. and corresponding chapters in the most recent 16th edition, including Chapters 207 and 210) relating to description and diagnosis of hearing and balance impairments.

Accordingly, in one aspect the present invention provides a method and pharmaceutical compositions for treating a mammal, preferably human, to prevent, reduce, or treat a hearing impairment, disorder or imbalance, preferably an ototoxin-induced hearing condition, by administering to a mammal in need of such treatment a chemically modified siRNA compound of the invention. One embodiment of the invention is a method for treating a hearing disorder or impairment wherein the ototoxicity results from administration of a therapeutically effective amount of an ototoxic pharmaceutical drug. Typical ototoxic drugs are chemotherapeutic agents, e.g. antineoplastic agents, and antibiotics. Other possible candidates include loop-diuretics, quinines or a quinine-like compound, PDE-5 inhibitors and salicylate or salicylate-like compounds.

Ototoxicity is a dose-limiting side effect of antibiotic administration. From 4 to 15% of patients receiving 1 gram per day for greater than 1 week develop measurable hearing loss, which slowly becomes worse and can lead to complete permanent deafness if treatment continues. Ototoxic aminoglycoside antibiotics include but are not limited to neomycin, paromomycin, ribostamycin, lividomycin, kanamycin, amikacin, tobramycin, viomycin, gentamicin, sisomicin, netilmicin, streptomycin, dibekacin, fortimicin, and dihydrostreptomycin, or combinations thereof. Particular antibiotics include neomycin B, kanamycin A, kanamycin B, gentamicin C1, gentamicin C1a, and gentamicin C2, and the like that are known to have serious toxicity, particularly ototoxicity and nephrotoxicity, which reduce the usefulness of such antimicrobial agents (see Goodman and Gilman's The Pharmacological Basis of Therapeutics, 6th ed., A. Goodman Gilman et al., eds; Macmillan Publishing Co., Inc., New York, pp. 1169-71 (1980)).

Ototoxicity is also a serious dose-limiting side-effect for anti-cancer agents. Ototoxic neoplastic agents include but are not limited to vincristine, vinblastine, cisplatin and cisplatin-like compounds and taxol and taxol-like compounds. Cisplatin-like compounds include carboplatin (Paraplatin®), tetraplatin, oxaliplatin, aroplatin and transplatin inter alia and are platinum based chemotherapeutics.

Diuretics with known ototoxic side-effect, particularly "loop" diuretics include, without being limited to, furosemide, ethacrylic acid, and mercurials.

Ototoxic quinines include but are not limited to synthetic substitutes of quinine that are typically used in the treatment of malaria. In some embodiments the hearing disorder is side-effect of inhibitors of type 5 phosphodiesterase (PDE-5), including sildenafil (Viagra®), vardenafil (Levitra®) and tadalafil (Cialis).

Salicylates, such as aspirin, are the most commonly used therapeutic drugs for their anti-inflammatory, analgesic, antipyretic and anti-thrombotic effects. Unfortunately, they too have ototoxic side effects. They often lead to tinnitus ("ringing in the ears") and temporary hearing loss. Moreover, if the drug is used at high doses for a prolonged time, the hearing impairment can become persistent and irreversible.

In some embodiments a method is provided for treatment of infection of a mammal by administration of an aminoglycoside antibiotic, the improvement comprising administering a therapeutically effective amount of one or more chemically modified siRNAs compounds which down-regulate expression a target gene, to the subject in need of such treatment to reduce or prevent ototoxin-induced hearing impairment associated with the antibiotic.

The methods and pharmaceutical and compositions of the present invention are also effective in the treatment of acoustic trauma or mechanical trauma, preferably acoustic or mechanical trauma that leads to inner ear hair cell loss. With more severe exposure, injury can proceed from a loss of adjacent supporting cells to complete disruption of the organ of Corti. Death of the sensory cell can lead to progressive Wallerian degeneration and loss of primary auditory nerve fibers. The methods of the invention are useful in treating acoustic trauma caused by a single exposure to an extremely loud sound, or following long-term exposure to everyday loud sounds above 85 decibels, for treating mechanical inner ear trauma, for example, resulting from the insertion of an electronic device into the inner ear or for preventing or minimizing the damage to inner ear hair cells associated with the operation.

Another type of hearing loss is presbycusis, which is hearing loss that gradually occurs in most individuals as they age. About 30-35 percent of adults between the ages of 65 and 75 years and 40-50 percent of people 75 and older experience hearing loss. The methods of the invention are useful in preventing, reducing or treating the incidence and/or severity of inner ear disorders and hearing impairments associated with presbycusis.

Definitions

For convenience certain terms employed in the specification, examples and claims are described herein.

It is to be noted that, as used herein, the singular forms "a", "an" and "the" include plural forms unless the content clearly dictates otherwise.

Where aspects or embodiments of the invention are described in terms of Markush groups or other grouping of alternatives, those skilled in the art will recognize that the invention is also thereby described in terms of any individual member or subgroup of members of the group.

A "polypeptide" refers to an amino acid sequence encoded by any of the above listed genes, including splice variants, isoforms, orthologs, or paralogs and the like.

An "inhibitor" is a compound which is capable of reducing the expression of a gene or the activity of the product of such gene to an extent sufficient to achieve a desired biological or physiological effect. The term "inhibitor" as used herein refers to one or more of an oligonucleotide or nucleic acid including antisense, siRNA, shRNA, miRNA and ribozyme. Inhibition may also be referred to as down-regulation or, for RNAi, silencing.

The term "inhibit" as used herein refers to reducing the expression of a gene or the activity of the product of such gene to an extent sufficient to achieve a desired biological or physiological effect. Inhibition may be complete or partial.

As used herein, the terms "polynucleotide" and "nucleic acid" may be used interchangeably and refer to nucleotide sequences comprising deoxyribonucleic acid (DNA), and ribonucleic acid (RNA). The terms should also be understood to include, as equivalents, analogs of either RNA or DNA made from nucleotide analogs. Throughout this application mRNA sequences are set forth as representing the corresponding genes. The terms "mRNA polynucleotide sequence" and mRNA are used interchangeably.

"Oligonucleotide" or "oligomer" refers to a single stranded or double stranded deoxyribonucleotide or ribonucleotide sequence or chimera thereof, from about 2 to about 100 nucleotides, preferably about 15 to about 60, or 18 to about 23. Each DNA or RNA nucleotide that makes tip the oligonucleotide may be independently natural or synthetic, and or modified or unmodified. Modifications include changes to the sugar moiety, the base moiety and or the linkages between nucleotides in the oligonucleotide. The oligonucleotides or oligonucleotide compounds of the present invention are single or double stranded compounds comprising deoxyribonucleotides, ribonucleotides, modified deoxyribonucleotides, modified ribonucleotides and combinations thereof.

"Nucleotide" or "nucleotide monomer" is meant to encompass a deoxyribonucleotide and a ribonucleotide, which may be natural or synthetic, and or modified or unmodified. Modifications include changes and substitutions to the sugar moiety, the base moiety and/or the internucleotide linkages.

Analogs of, or modifications to, a nucleotide/oligonucleotide are preferably employed with the present invention, provided that said analog or modification does not substantially adversely affect the function of the nucleotide/oligonucleotide. In some embodiments a chemical modification results in an increase in activity or stability or a reduction in of-target effects or induction of innate immune responses. Acceptable modifications include modifications of the sugar moiety, modifications of the base moiety, modifications in the internucleotide linkages and combinations thereof.

The nucleotides can be selected from naturally occurring or synthetic modified bases. Naturally occurring bases include adenine, guanine, cytosine, thymine and uracil. Modified bases of nucleotides include inosine, xanthine, hypoxanthine, 2-aminoadenine, 6-methyl, 2-propyl and other alkyl adenines, 5-halo uracil, 5-halo cytosine, 6-aza cytosine and 6-aza thymine, pseudo uracil, 4-thiouracil, 8-halo adenine, 8-aminoadenine, 8-thiol adenine, 8-thiolalkyl adenines, 8-hydroxyl adenine and other 8-substituted adenines, 8-halo guanines, 8-amino guanine, 8-thiol guanine, 8-thioalkyl guanines, 8-hydroxyl guanine and other substituted guanines, other aza and deaza adenines, other aza and deaza guanines, 5-trifluoromethyl uracil and 5-trifluoro cytosine.

In addition, compounds comprising nucleotide analogs prepared wherein the structure of one or more nucleotide is fundamentally altered and better suited as therapeutic or experimental reagents. An example of a nucleotide analog is a peptide nucleic acid (PNA) wherein the deoxyribose (or ribose) phosphate backbone in DNA (or RNA is replaced with a polyamide backbone which is similar to that found in peptides. PNA analogs have been shown to be resistant to enzymatic degradation and to have extended lives in vivo and in vitro.

Possible modifications to the sugar residue are manifold and include 2'-O alkyl, locked nucleic acid (LNA), glycol nucleic acid (GNA), threose nucleic acid (TNA), arabinoside, altritol (ANA) and other, 6-membered sugars including morpholinos, and cyclohexinyls.

LNA compounds are disclosed in. International Patent Publication Nos. WO 00/47599, WO 99/14226, and WO 98/39352. Examples of siRNA compounds comprising LNA nucleotides are disclosed in Elmen et al., (NAR 2005. 33(1): 439-447) and in International Patent Publication No. WO 2004/083430.

Backbone modifications, such as ethyl (resulting in a phospho-ethyl triester); propyl (resulting in a phospho-propyl triester); and butyl (resulting in a phospho-butyl triester) are also possible. Other backbone modifications include polymer backbones, cyclic backbones, acyclic backbones, thiophosphate-D-ribose backbones, amidates, phosphonoacetate derivatives. Certain structures include siRNA compounds having one or a plurality of 2'-5' internucleotide linkages (bridges or backbone).

Additional modifications which may be present in the molecules of the present invention include nucleoside modifications such as artificial nucleic acids, peptide nucleic acid (PNA), morpholino and locked nucleic acid (LNA), glycol nucleic acid (GNA), threose nucleic acid (TNA), arabinoside, and mirror nucleoside (for example, beta-L-deoxynucleoside instead of beta-D-deoxynucleoside Further, said molecules may additionally contain modifications on the sugar, such as 2'-alkyl, 2'-fluoro (2'-deoxy-2'-fluoro), 2'O-allyl, 2' amine and 2' alkoxy. Additional sugar modifications are discussed herein.

Further, the inhibitory nucleic acid molecules of the present invention may comprise one or more gaps and/or one or more nicks and/or one or more mismatches. Without wishing to be bound by theory, gaps, nicks and mismatches have the advantage of partially destabilizing the nucleic acid/siRNA, so that it may be more easily processed by endogenous cellular machinery such as DICER, DROSHA or RISC into its inhibitory components.

In the context of the present invention, a gap in a nucleic acid refers to the absence of one or more internal nucleotides in one strand, while a nick in a nucleic acid refers to the absence of an internucleotide linkage between two adjacent nucleotides in one strand. Any of the molecules of the present invention may contain one or more gaps and/or one or more nicks.

siRNAs and RNA Interference

RNA interference (RNAi) is a phenomenon involving double-stranded (ds) RNA-dependent gene specific posttranscriptional silencing. Originally, attempts to study this phenomenon and to manipulate mammalian cells experimentally were frustrated by an active, non-specific antiviral defense mechanism which was activated in response to long dsRNA molecules (Gil et al. Apoptosis, 2000. 5:107-114). Later it was discovered that synthetic duplexes of 21 nucleotide RNAs could mediate gene specific RNAi in mammalian cells, without the stimulation of the generic antiviral defense mechanisms (see Elbashir et al. Nature 2001, 411:494-498 and Caplen et al. PNAS USA 2001, 98:9742-9747). As a result, small interfering RNAs (siRNAs), which are short double-stranded RNAs, have become powerful tools in attempting to understand gene function. Thus RNA interference (RNAi) refers to the process of sequence-specific post-transcriptional gene silencing in mammals mediated by small interfering RNAs (siRNAs) (Fire et al, Nature 1998. 391, 806) or microRNAs (miRNA; Ambros, Nature 2004 431: 7006,350-55; and Bartel, Cell, 2004. 116(2):28'-97). The corresponding process in plants is commonly referred to as specific post transcriptional gene silencing or RNA silencing and is referred to as quelling in fungi.

A siRNA is a double-stranded RNA molecule which inhibits, either partially or fully, the expression of a gene/mRNA of its endogenous or cellular counterpart, or of an exogenous gene such as a viral nucleic acid. The mechanism of RNA interference is detailed infra.

Several studies have revealed that siRNA therapeutics are effective in vivo in both mammals and in humans. Bitko et al., have shown that specific siRNA molecules directed against the respiratory syncytial virus (RSV) nucleocapsid N gene are effective in treating mice when administered intranasally (Bitko et al., Nat. Med. 2005, 11(1):50-55). siRNA has recently been successfully used for inhibition in primates (Tolentino et al., Retina 2004. 24(1):132-138). For a review of the use of siRNA as therapeutics, see for example Barik (J. Mol. Med. 2005. 83: 764-773) or Dykxhoorn et al (2006. Gene Ther. 13:541-552).

siRNA Structures

The selection and synthesis of siRNA corresponding to known genes has been widely reported; (see for example Ui-Tel et al., J Biomed Biotech. 2006; 2006: 65052; Chalk et BBRC. 2004, 319(1): 264-74; Sioud & Leirdal, Met. Mol. Biol.; 2004, 252:457-69; Levenkova et al., Bioinform. 2004, 20(3):430-2; Ui-Tei et al., NAR. 2004, 32(3):936-48).

For examples of the use of, and production of, modified siRNA see, for example, Braasch et al., Biochem. 2003, 42(26):7967-75; Chiu et al., RNA, 2003, 9(9):1034-48; PCT publications WO 2004/015107 (atugen AG) and WO 02/44321 (Tuschl et al). U.S. Pat. Nos. 5,898,031 and 6,107, 094, teach chemically modified oligomers. US Patent Publication Nos. 2005/0080246 and 2005/0042647 relate to oligomeric compounds having an alternating motif and dsRNA compounds having chemically modified internucleoside linkages, respectively.

Other modifications have been disclosed. The inclusion of a 5'-phosphate moiety was shown to enhance activity of siRNAs in Drosophila embryos (Boutla, et al., Curr. Biol. 2001, 11:1776-1780) and is required for siRNA function in human HeLa cells (Schwarz et al., Mol. Cell, 2002, 10:537-48). Amarzguioui et al., (NAR, 2003, 31(2):589-95) showed that siRNA activity depended on the positioning of the 2'-O-methyl modifications. Holen et al (NAR. 2003, 31(9):2401-07) report that an siRNA having small numbers of 2'-O-methyl modified nucleosides gave good activity compared to wild type but that the activity decreased as the numbers of 2'-O-methyl modified nucleosides was increased. Chiu and Rana (RNA. 2003, 9:1034-48) teach that incorporation of 2'-O-methyl modified nucleosides in the sense or antisense strand (fully modified strands) severely reduced siRNA activity relative to unmodified siRNA. The placement of a 2'-O-methyl group at the 5'-terminus on the antisense strand was reported to severely limit activity whereas placement at the 3'-terminus of the antisense and at both termini of the sense strand was tolerated (Czauderna et al., NAR. 2003, 31(11):2705-16; WO 2004/015107). The molecules of the present invention offer an advantage in that they are non-toxic and may be formulated as pharmaceutical compositions for treatment of various diseases.

International Patent Publication No. WO 2008/050329 to the assignee of the present invention and hereby incorporated in its entirely relates to siRNA compounds, compositions comprising same and to methods of use thereof for treating diseases and disorders related to expression of proapoptotic genes. U.S. Ser. No. 11/655,610 relates to methods of treating hearing impairment by inhibiting a pro-apoptotic gene in general and p53 in particular. International Patent Publication No. WO 2005/119251 relates to methods of treating deafness. International Patent Publication No. WO/2005/055921 relates to foam compositions for treatment of ear disorders. U.S. Pat. No. 7,087,581 relates to methods of treating diseases and disorders of the inner ear.

According to one aspect the present invention provides a method for the treatment of ear disorders comprising the step of administering a pharmaceutical composition comprising administering a composition comprising a chemically modified inhibitory oligonucleotide compound; a permeability enhancer and pharmaceutically acceptable carrier. The compound comprises at least one modified nucleotide selected from the group consisting of a sugar modification, a base modification and an internucleotide linkage modification.

The present invention also relates to compounds which down-regulate expression of various genes, particularly to novel small interfering RNAs (siRNAs), and to the use of these novel siRNAs in the treatment of hearing loss, in the regeneration of inner ear cells and in preventing chemical-induced hearing loss.

A non-limiting list of human target genes useful in the present invention is provided in Table 1, set forth in SEQ ID NOS 1-36. In a preferred embodiment, the target gene is selected from one or more of: TP53BP2 (ASPP2), BNIP3, CASP2, NOX3, HRK, RAC1, DDIT4, DDIT4L, NOX4, HTRA2, CAPNS1 (Calpain), ID3, HES1, HES5, CDKN1B and ID3. The reference to mRNA associated with those genes is set forth therein. For each gene 19-mer, 21-mer and 23-mer sequences is generated, which are prioritized based on their score in the proprietary algorithm as the best sequences for targeting the human gene expression. The 21- or 23-mer siRNA sequences can also be generated by 5' and/or 3' extension of the 19-mer sequences disclosed herein. Such extension is preferably complementary to the corresponding mRNA sequence. Certain 23-mer oligomers were devised by this method where the order of the prioritization is the order of the corresponding 19-mer. The siRNA oligomers useful in practicing the invention are disclosed in Tables B of U.S. Ser. No. 11/978,089, assigned to the assignee of the present invention and which is hereby incorporated by reference in their entirety and are set forth as SEQ ID NOS:97-68654 in that application. Certain siRNA oligomers useful in the compositions and methods of the present invention are disclosed in U.S. Ser. Nos. 11/207,119, 11/811,112, 11/655,636, and International Patent Application Nos. PCT/IL2008/000797, PCT/IL2008/000874, PCT/IL2009/000053, PCT/IL2009/000302, assigned to the assignee of the present invention and which are hereby incorporated by reference in their entirety. Certain 19-mer antisense and sense oligonucleotides sequences useful in the preparation of siRNA compounds of various lengths are shown in FIG. 4. The abbreviations for cross species sequences are as follows: Chp: chimpanzee, Ms: Mouse, Chn: chinchilla; GP: guinea-pig.

In some embodiments the present invention provides a composition and method comprising a long oligonucleotide, typically about 41-500 nucleotides in length) comprising none or one or more stein and loop structures, which is processed intracellularly by endogenous cellular complexes (e.g. by DROSHA and DICER as described above) to produce one or more smaller double stranded oligonucleotides (siRNAs). In some embodiments the long oligonucleotide is a single stranded oligonucleotide comprising one or more stem and loop structures, wherein each stem region comprises a sense and corresponding antisense siRNA sequence. Any molecules, such as, for example, antisense DNA molecules which comprise the inhibitory sequences disclosed herein (with the appropriate nucleic acid modifications) are particularly desirable and may be used in the same capacity as their corresponding RNAs/siRNAs for all uses and methods disclosed herein.

Oligonucleotides

The present invention provides double-stranded oligonucleotides (e.g. siRNAs), which down-regulate the expression of a desired gene. An siRNA of the invention is a duplex oligoribonucleotide in which the sense strand is derived from the mRNA sequence of the desired gene, and the antisense strand is complementary to the sense strand. In general, some deviation from the target mRNA sequence is tolerated without compromising the siRNA activity (see e.g. Czauderna et al., NAR. 2003, 31(11):2705-2716). An siRNA of the invention inhibits gene expression on a post-transcriptional level with or without destroying the mRNA. Without being bound by theory, siRNA may target the mRNA for specific cleavage and degradation and/or may inhibit translation from the targeted message.

In various embodiments the siRNA comprises an RNA duplex comprising a first strand and a second strand, whereby the first strand comprises a ribonucleotide sequence at least partially complementary to about 18 to about 40 consecutive nucleotides of a target nucleic acid which is mRNA transcribed from a target gene, and the second strand comprises a ribonucleotide sequence at least partially complementary to the first strand and wherein said first strand and or said second strand comprises a one or more chemically modified ribonucleotides and or unconventional moieties.

In one embodiment the siRNA compound comprises at least one ribonucleotide comprising a 2' modification on the sugar moiety ("2' sugar modification"). In certain embodiments the compound comprises 2'O-alkyl or 2'-fluoro or 2'O-allyl or any other 2' modification, optionally on alternate positions. Other stabilizing modifications are also possible (e.g. terminal modifications). In some embodiments a preferred 2'O-alkyl is 2'O-methyl (methoxy, 2'OMe) sugar modification.

In some embodiments the backbone of the oligonucleotides is modified and comprises phosphate-D-ribose entities but may also contain thiophosphate-D-ribose entities, triester, thioate, 2'-5' bridged backbone (also may be referred to as 5'-2'), PACE and the like.

As used herein, the terms "non-pairing nucleotide analog" means a nucleotide analog which comprises a non-base pairing moiety including but not limited to: 6 des amino adenosine (Nebularine), 4-Me-indole, 3-nitropyrrole, 5-nitroindole, Ds, Pa, N3-Me ribo U, N3-Me riboT, N3-Me dC, N3-Me-dT, N1-Me-dG, N1-Me-dA, N3-ethyl-dC, N3-Me dC. In some embodiments the non-base pairing nucleotide analog is a ribonucleotide. In other embodiments it is a deoxyribonucleotide. In addition, analogues of polynucleotides may be prepared wherein the structure of one or more nucleotide is fundamentally altered and better suited as therapeutic or experimental reagents. An example of a nucleotide analogue is a peptide nucleic acid (PNA) wherein the deoxyribose (or ribose) phosphate backbone in DNA (or RNA is replaced with a polyamide backbone which is similar to that found in peptides. PNA analogues have been shown to be resistant to enzymatic degradation and to enhance stability in vivo and in vitro. Other useful modifications include polymer backbones, cyclic backbones, acyclic backbones, thiophosphate-D-ribose backbones, triester backbones, thioate backbones, 2'-5' bridged backbone, artificial nucleic acids, morpholino nucleic acids, glycol nucleic acid (GNA), threose nucleic acid (TNA), arabinoside, and mirror nucleoside (for example, beta-L-deoxyribonucleoside instead of beta-D-deoxyribonucleoside). The compounds of the present invention can be synthesized using one or more inverted nucleotides, for example inverted thymidine or inverted adenine (see, for example, Takei, et al., 2002, JBC 277(26):23800-06).

Additional modifications include terminal modifications on the 5' and/or 3' part of the oligonucleotides anti are also known as capping moieties. Such terminal modifications are selected from a nucleotide, a modified nucleotide, a lipid, a peptide, a sugar and inverted abasic moiety.

What is sometimes referred to in the present invention as an "abasic nucleotide" or "abasic nucleotide analog" is more properly referred to as a pseudo-nucleotide or an unconventional moiety. A nucleotide is a monomeric unit of nucleic acid, consisting of a ribose or deoxyribose sugar, a phosphate, and a base (adenine, guanine, thymine, or cytosine in DNA; adenine, guanine, uracil, or cytosine in RNA). A modified nucleotide comprises a modification in one or more of the sugar, phosphate and or base. The abasic pseudo-nucleotide lacks a base, and thus is not strictly a nucleotide.

The term "unconventional moiety" as used herein refers to abasic ribose moiety, an abasic deoxyribose moiety, a deoxyribonucleotide, a modified deoxyribonucleotide, a mirror nucleotide, a non-base pairing nucleotide analog and a nucleotide joined to an adjacent nucleotide by a 2'-5' internucleotide phosphate bond; bridged nucleic acids including LNA and ethylene bridged nucleic acids. In some embodiments of the present invention a preferred unconventional moiety is an abasic ribose moiety, an abasic deoxyribose moiety, a deoxyribonucleotide, a minor nucleotide, and a nucleotide joined to an adjacent nucleotide by a 2'-5' internucleotide phosphate bond.

Abasic deoxyribose moiety includes for example abasic deoxyribose-3'-phosphate; 1,2-dideoxy-D-ribofuranose-3-phosphate; L4-anhydro-2-deoxy-D-ribitol-3-phosphate. Inverted abasic deoxyribose moiety includes inverted deoxyriboabasic; 3',5' inverted deoxyabasic 5'-phosphate.

A "mirror" nucleotide is a nucleotide with reversed chirality to the naturally occurring or commonly employed nucleotide, i.e., a minor image (L-nucleotide) of the naturally occurring (D-nucleotide), also referred to as L-RNA in the case of a mirror ribonucleotide, and "spiegelmer". The nucleotide can be a ribonucleotide or a deoxyribonucleotide and my further comprise at least one sugar, base and or backbone modification. See U.S. Pat. No. 6,586,238. Also, U.S. Pat. No. 6,602,858 discloses nucleic acid catalysts comprising at least one L-nucleotide substitution. Mirror nucleotide includes for example L-DNA (L-deoxyriboadenosine-3'-phosphate (mirror dA); L-deoxyribocytidine-3'-phosphate (mirror dC); L-deoxyriboguanosine-3'-phosphate (mirror dG); L-deoxyribothymidine-3'-phosphate (mirror image dT)) and L-RNA (L-riboadenosine-3'-phosphate (mirror rA); L-ribocytidine-3'-phosphate (mirror rC); L-riboguanosine-3'-phosphate (mirror rG); L-ribouracil-3'-phosphate (mirror dU).

The term "capping moiety" as used herein includes abasic ribose moiety, abasic deoxyribose moiety, modifications abasic ribose and abasic deoxyribose moieties including 2' O alkyl modifications; inverted abasic ribose and abasic deoxyribose moieties and modifications thereof; C6-imino-Pi; a mirror nucleotide including L-DNA and L-RNA; 5'O-Me nucleotide; and nucleotide analogs including 4',5'-methylene nucleotide; 1-(β-D-erythrofuranosyl)nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 12-aminododecyl phosphate; hydroxypropyl phosphate; 1,5-anhydrohexitol nucleotide; alpha-nucleotide; threo-pentofuranosyl nucleotide; acyclic 3',4'-seco nucleotide; 3,4-dihydroxybutyl nucleotide; 3,5-dihydroxypentyl nucleotide, 5'-5'-inverted abasic moiety; 1,4-butanediol phosphate; 5'-amino; and bridging or non bridging methylphosphonate and 5'-mercapto moieties.

Certain preferred capping moieties are abasic ribose or abasic deoxyribose moieties; inverted abasic ribose or abasic deoxyribose moieties; C6-amino-Pi; a mirror nucleotide including L-DNA and L-RNA.

A further end modification is a biotin group. Such biotin group may preferably be attached to either the most 5' or the most 3' nucleotide of the first and/or second strand or to both ends. In a more preferred embodiment the biotin group is coupled to a polypeptide or a protein. It is also within the scope of the present invention that the polypeptide or protein is attached through any of the other aforementioned end modifications.

The various end modifications as disclosed herein are preferably located at the ribose moiety of a nucleotide of the nucleic acid according to the present invention. More particularly, the end modification may be attached to or replace any of the OH-groups of the ribose moiety, including but not limited to the 2'OH, 3'OH and 5'OH position, provided that the nucleotide thus modified is a terminal nucleotide. Inverted abasic or abasic are nucleotides, either deoxyribonucleotides or ribonucleotides which do not have a nucleobase moiety (for example see Sternberger, et al., (2002). Antisense Nucleic Acid Drug Dev, 12, 131-43).

Modified deoxyribonucleotide includes, for example 5'OMe DNA (5-methyl-deoxyriboguanosine-3'-phosphate) which may be useful as a nucleotide in the 5' terminal position (position number 1); PACE (deoxyriboadenine 3' phosphonoacetate, deoxyribocytidine 3' phosphonoacetate, deoxyriboguanosine 3' phosphonoacetate, deoxyribothymidine 3' phosphonoacetate.

Bridged nucleic acids include LNA (2'-O, 4'-C-methylene bridged Nucleic Acid adenosine 3' monophosphate, 2'-O, 4'-C-methylene bridged Nucleic Acid 5-methyl-cytidine 3' monophosphate, 2'-O, 4'-C-methylene bridged Nucleic Acid guanosine 3' monophosphate, 5-methyl-uridine (or thymidine) 3' monophosphate); and ENA (2'-O, 4'-C-ethylene bridged nucleic acid adenosine 3' monophosphate, 2'-O, 4'-C-ethylene bridged nucleic acid 5-methyl-cytidine 3' monophosphate, 2'-O, 4'-C-ethylene bridged nucleic acid guanosine 3' monophosphate, 5-methyl-uridine (or thymidine) 3' monophosphate).

In certain embodiments the complementarity between said first strand and the target nucleic acid is perfect. In some embodiments, the strands are substantially complementary, i.e. having one, two or up to three mismatches between said first strand and the target nucleic acid. Substantially complementary refers to complementarity of greater than about 84%, to another sequence. For example in a duplex region consisting of 19 base pairs one mismatch results in 94.7% complementarity, two mismatches results in about 89.5% complementarity and 3 mismatches results in about 84.2% complementarity, rendering the duplex region substantially complementary. Accordingly substantially identical refers to identity of greater than about 84%, to another sequence.

In some embodiments the first strand and the second strand of the compound are linked by a loop structure, which is comprised of a non-nucleic acid polymer such as, inter cilia, polyethylene glycol. Alternatively, the loop structure is comprised of a nucleic acid, including modified and non-modified ribonucleotides and modified and non-modified deoxyribonucleotides.

In further embodiments, the 5'-terminus of the first strand of the siRNA is linked to the 3'-terminus of the second strand, or the 3'-terminus of the first strand is linked to the 5'-terminus of the second strand, said linkage being via a nucleic acid linker typically having a length between 2-100 nucleobases, preferably about 2 to about 30 nucleobases.

In preferred embodiments of the compounds of the invention having alternating ribonucleotides modified in at least one of the antisense and the sense strands of the compound, for 19 mer and 23 mer oligomers the ribonucleotides at the 5' and 3' termini of the antisense strand are modified in their sugar residues, and the ribonucleotides at the 5' and 3' termini of the sense strand are unmodified in their sugar residues. For 21 mer oligomers the ribonucleotides at the 5' and 3' termini of the sense strand are modified in their sugar residues, and the ribonucleotides at the 5' and 3' termini of the antisense strand are unmodified in their sugar residues, or may have an optional additional modification at the 3' terminus. As mentioned above, it is preferred that the middle nucleotide of the antisense strand is unmodified.

According to one preferred embodiment of the invention, the antisense and the sense strands of the oligonucleotide/siRNA are phosphorylated at the 3'-terminus and not at the 5'-terminus. According to another preferred embodiment of the invention, the antisense and the sense strands are non-phosphorylated. According to yet another preferred embodiment of the invention, the 5' most ribonucleotide in the sense strand is modified to abolish any possibility of in vivo 5'-phosphorylation.

Any siRNA sequence can be prepared having any of the modifications/structures disclosed herein. The compound comprising a combination of sequence plus structure is useful in the treatment of the conditions disclosed herein.

Structural Motifs

According to the present invention the siRNA compounds are chemically and or structurally modified according to one of the following modifications set forth in Structures (A)-(P) or as tandem siRNA or RNAstar.

In one aspect the present invention provides a compound set forth as Structure (A):

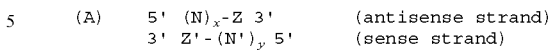

wherein each of N and N' is a nucleotide selected from an unmodified ribonucleotide, a modified ribonucleotide, an unmodified deoxyribonucleotide and a modified deoxyribonucleotide;

wherein each of $(N)_x$ and $(N')_y$ is an oligonucleotide in which each consecutive N or N' is joined to the next N or N' by a covalent bond;

wherein each of x and y is an integer between 18 and 40;

wherein each of Z and Z' may be present or absent, but if present is 1-5 consecutive nucleotides covalently attached at the 3' terminus of the strand in which it is present;

wherein the sequence of $(N')_y$ is a sequence substantially complementary to $(N)x$; and wherein the sequence of $(N)_x$ comprises an antisense sequence substantially complementary to from about 18 to about 40 consecutive ribonucleotides in an mRNA of a target gene associated with an ear disorder.

In certain embodiments the present invention provides a compound having structure (B)

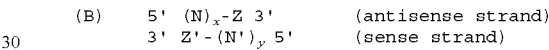

wherein each of $(N)_x$ and $(N')_y$ is an oligomer in which each consecutive N or N' is an unmodified ribonucleotide or a modified ribonucleotide joined to the next N or N' by a covalent bond;

wherein each of Z and Z' may be present or absent, but if present is 1-5 consecutive nucleotides covalently attached at the 3' terminus of the strand in which it is present;

wherein each of x and y=19, 21 or 23 and $(N)_x$ and $(N')_y$ are fully complementary wherein alternating ribonucleotides in each of $(N)_x$ and $(N')_y$ are modified to result in a 2'-O-methyl modification in the sugar residue of the ribonucleotides;

wherein the sequence of $(N')_y$ is a sequence substantially complementary to $(N)x$; and wherein the sequence of $(N)_x$ comprises an antisense sequence substantially complementary to the substantially complementary to from about 18 to about 40 consecutive ribonucleotides in an mRNA of a target gene associated with an ear disorder.

In some embodiments each of $(N)_x$ and $(N')_y$ is independently phosphorylated or non-phosphorylated at the 3' and 5' termini.

In certain embodiments wherein each of x and y=19 or 23, each N at the 5' and 3' termini of $(N)_x$ is modified; and each N' at the 5' and 3' termini of $(N')_y$ is unmodified.

In certain embodiments wherein each of x and y=21, each N at the 5' and 3' termini of $(N)_x$ is unmodified; and each N' at the 5' and 3' termini of $(N')_y$ is modified.

In particular embodiments, when x and y=19, the siRNA is modified such that a 2'-O-methyl (2'-OMe) group is present on the first, third, fifth, seventh, ninth, eleventh, thirteenth, fifteenth, seventeenth and nineteenth nucleotide of the antisense strand $(N)_x$, and whereby the very same modification, i.e. a 2'-OMe group, is present at the second, fourth, sixth, eighth, tenth, twelfth, fourteenth, sixteenth and eighteenth nucleotide of the sense strand (N')$_y$. In various embodiments these particular siRNA compounds are blunt ended at both termini.

In some embodiments, the present invention provides a compound having Structure (C):

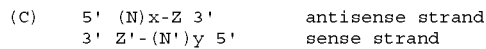

```
(C)    5' (N)x-Z 3'         antisense strand
       3' Z'-(N')y 5'        sense strand
``` wherein each of N and N' is a nucleotide independently selected from an unmodified ribonucleotide, a modified ribonucleotide, an unmodified deoxyribonucleotide and a modified deoxyribonucleotide;

wherein each of (N)x and (N')y is an oligomer in which each consecutive nucleotide is joined to the next nucleotide by a covalent bond and each of x and y is an integer between 18 and 40;

wherein in (N)x the nucleotides are unmodified or (N)x comprises alternating modified ribonucleotides and unmodified ribonucleotides; each modified ribonucleotide being modified so as to have a 2'-O-methyl on its sugar and the ribonucleotide located at the middle position of (N)x being modified or unmodified preferably unmodified;

wherein (N')y comprises unmodified ribonucleotides further comprising one modified nucleotide at a terminal or penultimate position, wherein the modified nucleotide is selected from the group consisting of a mirror nucleotide, a bicyclic nucleotide, a 2'-sugar modified nucleotide, an altritol nucleotide, or a nucleotide joined to an adjacent nucleotide by an internucleotide linkage selected from a 2'-5' phosphodiester bond, a P-alkoxy linkage or a PACE linkage;

wherein if more than one nucleotide is modified in (N')y, the modified nucleotides may be consecutive;

wherein each of Z and Z' may be present or absent, but if present is 1-5 deoxyribonucleotides covalently attached at the 3' terminus of any oligomer to which it is attached;

wherein the sequence of (N')$_y$ comprises a sequence substantially complementary to (N)x; and wherein (N)$_x$ comprises an antisense sequence substantially complementary to from about 18 to about 40 consecutive ribonucleotides in an mRNA of a target gene associated with an ear disorder.

In particular embodiments, x=y=19 and in (N)x each modified ribonucleotide is modified so as to have a 2'-O-methyl on its sugar and the ribonucleotide located at the middle of (N)x is unmodified. Accordingly, in a compound wherein x=19, (N)x comprises 2'-β-methyl sugar modified ribonucleotides at positions 1, 3, 5, 7, 9, 11, 13, 15, 17 and 19. In other embodiments, (N)x comprises 2'O Me modified ribonucleotides at positions 2, 4, 6, 8, 11, 13, 15, 17 and 19 and may further comprise at least one abasic or inverted abasic unconventional moiety for example in position 5. In other embodiments, (N)x comprises 2'O Me modified ribonucleotides at positions 2, 4, 8, 11, 13, 15, 17 and 19 and may further comprise at least one abasic or inverted abasic unconventional moiety for example in position 6. In other embodiments, (N)x comprises 2'O Me modified ribonucleotides at positions 2, 4, 6, 8, 11, 13, 15, 17 and 19 and may further comprise at least one abasic or inverted abasic unconventional moiety for example in position 14. In other embodiments, (N)x comprises 2'O Me modified ribonucleotides at positions 1, 2, 3, 7, 9, 11, 13, 15, 17 and 19 and may further comprise at least one abasic or inverted abasic unconventional moiety for example in position 5. In other embodiments, (N)x comprises 2'O Me modified ribonucleotides at positions 1, 2, 3, 5, 7, 9, 11, 13, 15, 17 and 19 and may further comprise at least one abasic or inverted abasic unconventional moiety for example in position 6. In other embodiments, (N)x comprises 2'O Me modified ribonucleotides at positions 1, 2, 3, 5, 7, 9, 11, 13, 17 and 19 and may further comprise at least one abasic or inverted abasic unconventional moiety for example in position 15. In other embodiments, (N)x comprises 2'O Me modified ribonucleotides at positions 1, 2, 3, 5, 7, 9, 11, 13, 15, 17 and 19 and may further comprise at least one abasic or inverted abasic unconventional moiety for example in position 14. In other embodiments, (N)x comprises 2'O Me modified ribonucleotides at positions 2, 4, 6, 7, 9, 11, 13, 15, 17 and 19 and may further comprise at least one abasic or inverted abasic unconventional moiety for example in position 5. In other embodiments, (N)x comprises 2'O Me modified ribonucleotides at positions 1, 2, 4, 6, 7, 9, 11, 13, 15, 17 and 19 and may further comprise at least one abasic or inverted abasic unconventional moiety for example in position 5. In other embodiments, (N)x comprises 2'O Me modified ribonucleotides at positions 2, 4, 6, 8, 11, 13, 14, 16, 17 and 19 and may further comprise at least one abasic or inverted abasic unconventional moiety for example in position 15. In other embodiments, (N)x comprises 2'O Me modified ribonucleotides at positions 1, 2, 3, 5, 7, 9, 11, 13, 14, 16, 17 and 19 and may further comprise at least one abasic or inverted abasic unconventional moiety for example in position 15. In other embodiments, (N)x comprises 2'O Me modified ribonucleotides at positions 2, 4, 6, 8, 11, 13, 15, 17 and 19 and may further comprise at least one abasic or inverted abasic unconventional moiety for example in position 7. In other embodiments, (N)x comprises 2'O Me modified ribonucleotides at positions 2, 4, 6, 11, 13, 15, 17 and 19 and may further comprise at least one abasic or inverted abasic unconventional moiety for example in position 8. In other embodiments, (N)x comprises 2'O Me modified ribonucleotides at positions 2, 4, 6, 8, 11, 13, 15, 17 and 19 and may further comprise at least one abasic or inverted abasic unconventional moiety for example in position 9. In other embodiments, (N)x comprises 2'O Me modified ribonucleotides at positions 2, 4, 6, 8, 11, 13, 15, 17 and 19 and may further comprise at least one abasic or inverted abasic unconventional moiety for example in position 10. In other embodiments, (N)x comprises 2'O Me modified ribonucleotides at positions 2, 4, 6, 8, 13, 15, 17 and 19 and may further comprise at least one abasic or inverted abasic unconventional moiety for example in position 11. In other embodiments, (N)x comprises 2'O Me modified ribonucleotides at positions 2, 4, 6, 8, 11, 13, 15, 17 and 19 and may further comprise at least one abasic or inverted abasic unconventional moiety for example in position 12. In other embodiments, (N)x comprises 2'O Me modified ribonucleotides at positions 2, 4, 6, 8, 11, 15, 17 and 19 and may further comprise at least one abasic or inverted abasic unconventional moiety for example in position 13.

In yet other embodiments (N)x comprises at least one nucleotide mismatch relative to the one of the genes. In certain preferred embodiments, (N)x comprises a single nucleotide mismatch on position 5, 6, or 14. In one embodiment of Structure (C), at least two nucleotides at either or both the 5' and 3' termini of (N')y are joined by a 2'-5' phosphodiester bond. In certain preferred embodiments x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified; and three nucleotides at the 3' terminus of (N')y are joined by two 2'-5' phosphodiester bonds (set forth herein as Structure I). In other preferred embodiments, x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified; and four consecutive nucleotides at the 5' terminus of (N')y are joined by three 2'-5' phosphodiester bonds. In a further embodiment, an additional nucleotide located in the middle position of (N)y may be modified with 2'-O-methyl on its sugar. In another preferred embodiment, in (N)x the nucleotides alternate between 2'-O-methyl modified ribonucleotides and unmodified ribonucleotides, and in (N')y four consecutive nucleotides at the 5' terminus are joined by three 2'-5' phosphodiester bonds and the 5' terminal nucleotide or two or three consecutive nucleotides at the 5' terminus comprise 3'-O-methyl modifications.

In certain preferred embodiments of Structure C, x=y=19 and in (N')y, at least one position comprises an abasic or inverted abasic unconventional moiety, preferably five positions comprises an abasic or inverted abasic unconventional moieties. In various embodiments, the following positions comprise an abasic or inverted abasic: positions 1 and 16-19, positions 15-19, positions 1-2 and 17-19, positions 1-3 and 18-19, positions 1-4 and 19 and positions 1-5. (N')y may further comprise at least one LNA nucleotide.

In certain preferred embodiments of Structure C, x=y=19 and in (N')y the nucleotide in at least one position comprises a mirror nucleotide, a deoxyribonucleotide and a nucleotide joined to an adjacent nucleotide by a 2'-5' internucleotide bond.

In certain preferred embodiments of Structure C, x=y=19 and (N')y comprises a mirror nucleotide. In various embodiments the mirror nucleotide is an L-DNA nucleotide. In certain embodiments the L-DNA is L-deoxyribocytidine. In some embodiments (N')y comprises L-DNA at position 18. In other embodiments (N')y comprises L-DNA at positions 17 and 18. In certain embodiments (N')y comprises L-DNA substitutions at positions 2 and at one or both of positions 17 and 18. In certain embodiments (N')y further comprises a 5' terminal cap nucleotide such as 5'-O-methyl DNA or an abasic or inverted abasic moiety as an overhang.

In yet other embodiments (N')y comprises a DNA at position 15 and L-DNA at one or both of positions 17 and 18. In that structure, position 2 may further comprise an L-DNA or an abasic unconventional moiety.

Other embodiments of Structure C are envisaged wherein x=y=21 or wherein x=y=23; in these embodiments the modifications for (N')y discussed above instead of being on positions 15, 16, 17, 18 are on positions 17, 18, 19, 20 for 21 mer and on positions 19, 20, 21, 22 for 23 mer; similarly the modifications at one or both of positions 17 and 18 are on one or both of positions 19 or 20 for the 21 mer and one or both of positions 21 and 22 for the 23 mer. All modifications in the 19 mer are similarly adjusted for the 21 and 23 mer.

According to various embodiments of Structure (C), in (N')y 2, 3, 4, 5, 6, 7, 8, 9, 10, 11, 12, 13 or 14 consecutive ribonucleotides at the 3' terminus are linked by 2'-5' internucleotide linkages. In one preferred embodiment, four consecutive nucleotides at the 3' terminus of (N')y are joined by three 2'-5' phosphodiester bonds, wherein one or more of the 2'-5' nucleotides which form the 2'-5' phosphodiester bonds further comprises a 3'-O-methyl sugar modification. Preferably the 3' terminal nucleotide of (N')y comprises a 2'-O-methyl sugar modification. In certain preferred embodiments of Structure C, x=y=19 and in (N')y two or more consecutive nucleotides at positions 15, 16, 17, 18 and 19 comprise a nucleotide joined to an adjacent nucleotide by a 2'-5' internucleotide bond. In various embodiments the nucleotide forming the 2'-5' internucleotide bond comprises a 3' deoxyribose nucleotide or a 3' methoxy nucleotide.

In some embodiments the nucleotides at positions 17 and 18 in (N')y are joined by a 2'-5' internucleotide bond. In other embodiments the nucleotides at positions 16, 17, 18, 16-17, 17-18, or 16-18 in (N')y are joined by a 2'-5' internucleotide bond.

In certain embodiments (N')y comprises an L-DNA at position 2 and 2'-5' internucleotide bonds at positions 16-17, 17-18, or 16-18. In certain embodiments (N')y comprises 2'-5' internucleotide bonds at positions 16-17, 17-18, or 16-18 and a 5' terminal cap nucleotide.

According to various embodiments of Structure (C), in (N')y 2, 3, 4, 5, 6, 7, 8, 9, 10, 11, 12, 13 or 14 consecutive nucleotides at either terminus or 2-8 modified nucleotides at each of the 5' and 3' termini are independently mirror nucleotides. In some embodiments the mirror nucleotide is an L-ribonucleotide. In other embodiments the mirror nucleotide is an L-deoxyribonucleotide. The mirror nucleotide may further be modified at the sugar or base moiety or in an internucleotide linkage.

In one preferred embodiment of Structure (C), the 3' terminal nucleotide or two or three consecutive nucleotides at the 3' terminus of (N')y are L-deoxyribonucleotides.

In other embodiments of Structure (C), in (N')y 2, 3, 4, 5, 6, 7, 8, 9, 10, 11, 12, 13 or 14 consecutive ribonucleotides at either terminus or 2-8 modified nucleotides at each of the 5' and 3' termini are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe). In one series of preferred embodiments, three, four or five consecutive nucleotides at the 5' terminus of (N')y comprise the 2'-OMe modification. In another preferred embodiment, three consecutive nucleotides at the 3' terminus of (N')y comprise the 2'-O-methyl modification.

In some embodiments of Structure (C), in (N')y 2, 3, 4, 5, 6, 7, 8, 9, 10, 11, 12, 13 or 14 consecutive ribonucleotides at either or 2-8 modified nucleotides at each of the 5' and 3' termini are independently bicyclic nucleotide. In various embodiments the bicyclic nucleotide is a locked nucleic acid (LNA). A 2'-O, 4'-C-ethylene-bridged nucleic acid (ENA) is a species of LNA (see below).

In various embodiments (N')y comprises modified nucleotides at the 5' terminus or at both the 3' and 5' termini.

In some embodiments of Structure (C), at least two nucleotides at either or both the 5' and 3' termini of (N')y are joined by P-ethoxy backbone modifications. In certain preferred embodiments x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle position of (N)x being unmodified; and four consecutive nucleotides at the 3' terminus or at the 5' terminus of (N')y are joined by three P-ethoxy backbone modifications. In another preferred embodiment, three consecutive nucleotides at the 3' terminus or at the 5' terminus of (N')y are joined by two P-ethoxy backbone modifications.

In some embodiments of Structure (C), in (N')y 2, 3, 4, 5, 6, 7 or 8, consecutive ribonucleotides at each of the 5' and 3' termini are independently mirror nucleotides, nucleotides joined by 2'-5' phosphodiester bond, 2' sugar modified nucleotides or bicyclic nucleotide. In one embodiment, the modification at the 5' and 3' termini of (N')y is identical. In one preferred embodiment, four consecutive nucleotides at the 5' terminus of (N')y are joined by three 2'-5' phosphodiester bonds and three consecutive nucleotides at the 3' terminus of (N')y are joined by two 2'-5' phosphodiester bonds. In another embodiment, the modification at the 5' terminus of (N')y is different from the modification at the 3' terminus of (N')y. In one specific embodiment, the modified nucleotides at the 5' terminus of (N')y are mirror nucleotides and the modified nucleotides at the 3' terminus of (N')y are joined by phosphodiester bond. In another specific embodiment, three consecutive nucleotides at the 5' terminus of (N')y are LNA nucleotides and three consecutive nucleotides at the 3' terminus of (N')y are joined by two 2'-5' phosphodiester bonds. In (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified, or the ribonucleotides in (N)x being unmodified In another embodiment of Structure (C), the present invention provides a compound wherein x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified; three nucleotides at the 3' terminus of (N')y are joined by two 2'-5' phosphodiester bonds and three nucleotides at the 5' terminus of (N')y are LNA such as ENA.

In another embodiment of Structure (C), five consecutive nucleotides at the 5' terminus of (N')y comprise the 2'-O-methyl sugar modification and two consecutive nucleotides at the 3' terminus of (N')y are L-DNA.

In yet another embodiment, the present invention provides a compound wherein x=y=19 or x=y=23; (N)x consists of unmodified ribonucleotides; three consecutive nucleotides at the 3' terminus of (N')y are joined by two 2'-5' phosphodiester bonds and three consecutive nucleotides at the 5' terminus of (N')y are LNA such as ENA.

According to other embodiments of Structure (C), in (N')y the 5' or 3' terminal nucleotide, or 2, 3, 4, 5 or 6 consecutive nucleotides at either termini or 1-4 modified nucleotides at each of the 5' and 3' termini are independently phosphonocarboxylate or phosphinocarboxylate nucleotides (PACE nucleotides). In some embodiments the PACE nucleotides are deoxyribonucleotides. In some preferred embodiments in (N')y, 1 or 2 consecutive nucleotides at each of the 5' and 3' termini are PACE nucleotides.

In some embodiments, the present invention provides a compound having Structure (D):

```
(D)    5' (N)x-Z 3'          antisense strand
       3' Z'-(N')y 5'         sense strand
``` wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is an integer between 18 and 40;

wherein (N)x comprises unmodified ribonucleotides further comprising one modified nucleotide at the 3' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage:

wherein (N')y comprises unmodified ribonucleotides further comprising one modified nucleotide at the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of (N')y is a sequence substantially complementary to (N)x; and wherein (N)x comprises an antisense sequence substantially complementary to from about 18 to about 40 consecutive ribonucleotides in an mRNA of a target gene associated with an ear disorder.

In one embodiment of Structure (D), x=y=19 or x=y=23; (N)x comprises unmodified ribonucleotides in which two consecutive nucleotides linked by one 2'-5' internucleotide linkage at the 3' terminus; and (N')y comprises unmodified ribonucleotides in which two consecutive nucleotides linked by one 2'-5' internucleotide linkage at the 5' terminus.

In some embodiments, x=y=19 or x=y=23; (N)x comprises unmodified ribonucleotides in which three consecutive nucleotides at the 3' terminus are joined together by two 2'-5' phosphodiester bonds; and (N')y comprises unmodified ribonucleotides in which four consecutive nucleotides at the 5' terminus are joined together by three 2'-5' phosphodiester bonds (set forth herein as Structure II).

According to various embodiments of Structure (D) 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are linked by 2'-5' internucleotide linkages.

According to one preferred embodiment of Structure (D), four consecutive nucleotides at the 5' terminus of (N')y are joined by three 2'-5' phosphodiester bonds and three consecutive nucleotides at the 3' terminus of (N')x are joined by two 2'-5' phosphodiester bonds. Three nucleotides at the 5' terminus of (N')y and two nucleotides at the 3' terminus of (N')x may also comprise 3'-O-methyl modifications.

According to various embodiments of Structure (D), 2, 3, 4, 5, 6, 7, 8, 9, 10, 11, 12, 13 or 14 consecutive nucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently mirror nucleotides. In some embodiments the mirror is an L-ribonucleotide. In other embodiments the mirror nucleotide is L-deoxyribonucleotide.

In other embodiments of Structure (D), 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In one preferred embodiment of Structure (D), five consecutive nucleotides at the 5' terminus of (N')y comprise a 2'OMe sugar modification and five consecutive nucleotides at the 3' terminus of (N')x comprise the 2'OMe sugar modification. In another preferred embodiment of Structure (D), ten consecutive nucleotides at the 5' terminus of (N')y comprise the 2'OMe sugar modification and five consecutive nucleotides at the 3' terminus of (N')x comprise the 2'OMe sugar modification. In another preferred embodiment of Structure (D), thirteen consecutive nucleotides at the 5' terminus of (N')y comprise the 2'OMe sugar modification and five consecutive nucleotides at the 3' terminus of (N')x comprise the 2'-O-methyl modification.

In some embodiments of Structure (D), in (N')y 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments of Structure (D), (N')y comprises a modified nucleotide selected from a bicyclic nucleotide, a 2' sugar modified nucleotide, a mirror nucleotide, an altritol nucleotide or a nucleotide joined to an adjacent nucleotide by an internucleotide linkage selected from a 2'-5' phosphodiester bond, a P-alkoxy linkage or a PACE linkage;

In various embodiments of Structure (D), (N)x comprises a modified nucleotide selected from a bicyclic nucleotide, a 2' sugar modified nucleotide, a mirror nucleotide, an altritol nucleotide or a nucleotide joined to an adjacent nucleotide by an internucleotide linkage selected from a 2'-5' phosphodiester bond, a P-alkoxy linkage or a PACE linkage;

In embodiments wherein each of the 3' and 5' termini of the same strand comprises a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In one specific embodiment of Structure (D), five consecutive nucleotides at the 5' terminus of (N')y comprise the 2'OMe sugar modification and two consecutive nucleotides at the 3' terminus of (N')y are L-DNA. In addition, the compound may further comprise five consecutive 2'OMe sugar modified nucleotides at the 3' terminus of (N')x.

In various embodiments of Structure (D), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (E):

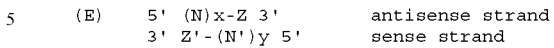

(E)   5' (N)x-Z 3'      antisense strand
      3' Z'-(N')y 5'    sense strand wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is an integer between 18 and 40;

wherein (N)x comprises unmodified ribonucleotides further comprising one modified nucleotide at the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein (N')y comprises unmodified ribonucleotides further comprising one modified nucleotide at the 3' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of $(N')_y$ is a sequence substantially complementary to (N)x; and wherein the sequence of $(N)_x$ comprises an antisense sequence substantially complementary to from about 18 to about 40 consecutive ribonucleotides in an mRNA of a target gene associated with an ear disorder.

In certain preferred embodiments the ultimate nucleotide at the 5' terminus of (N)x is unmodified.

According to various embodiments of Structure (E) 2, 3, 4, 5, 6, 7, 8, 9, 10, 11, 12, 13 or 14 consecutive ribonucleotides starting at the ultimate or penultimate position of the 5' terminus of $(N)_x$, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are linked by 2'-5' internucleotide linkages.

According to various embodiments of Structure (E), 2, 3, 4, 5, 6, 7, 8, 9, 10, II, 12, 13 or 14 consecutive nucleotides starting at the ultimate or penultimate position of the 5' terminus of $(N)_x$, preferably starting at the 5' penultimate position, and 2, 3, 4, 5, 6, 7, 8, 9, 10, 11, 12, 13 or 14 consecutive nucleotides starting at the ultimate or penultimate position of the 3' terminus of (N')y are independently mirror nucleotides. In some embodiments the mirror is an L-ribonucleotide. In other embodiments the mirror nucleotide is L-deoxyribonucleotide.

In other embodiments of Structure (E), 2, 3, 4, 5, 6, 7, 8, 9, 10, 11, 12, 13 or 14 consecutive ribonucleotides starting at the ultimate or penultimate position of the 5' terminus of $(N)_x$, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In some embodiments of Structure (E), in (N')y 2, 3, 4, 5, 6, 7, 8, 9, 10, 11, 12, 13 or 14 consecutive ribonucleotides starting at the ultimate or penultimate position of the 5' terminus of (N)$_x$, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments of Structure (E), (N')y comprises modified nucleotides selected from a bicyclic nucleotide, a 2' sugar modified nucleotide, a mirror nucleotide, an altritol nucleotide, a nucleotide joined to an adjacent nucleotide by a P-alkoxy backbone modification or a nucleotide joined to an adjacent nucleotide by an internucleotide linkage selected from a 2'-5' phosphodiester bond, a P-alkoxy linkage or a PACE linkage at the 3' terminus or at each of the 3' and 5' termini.

In various embodiments of Structure (E), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In one embodiment where both 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (E), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (F):

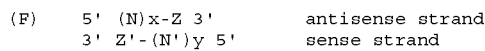

(F)  5'  (N)x-Z  3'      antisense strand
     3'  Z'-(N')y  5'    sense strand wherein each of N and N' is a nucleotide selected from an unmodified ribonucleotide, a modified ribonucleotide, an unmodified deoxyribonucleotide or a modified deoxyribonucleotide;
wherein each of (N)x and (N')y is an oligomer in which each consecutive nucleotide is joined to the next nucleotide by a covalent bond and each of x and y is an integer between 18 and 40;

wherein each of (N)x and (N')y comprise unmodified ribonucleotides in which each of (N)x and (N')y independently comprise one modified nucleotide at the 3' terminal or penultimate position wherein the modified nucleotide is selected from the group consisting of a bicyclic nucleotide, a 2' sugar modified nucleotide, a mirror nucleotide, a nucleotide joined to an adjacent nucleotide by a P-alkoxy backbone modification or a nucleotide joined to an adjacent nucleotide by a 2'-5' phosphodiester bond;
wherein in each of (N)x and (N')y modified and unmodified nucleotides are not alternating;
wherein each of Z and Z' may be present or absent, but if present is 1-5 deoxyribonucleotides covalently attached at the 3' terminus of any oligomer to which it is attached;
wherein the sequence of (N')y is a sequence substantially complementary to (N)x; and wherein the sequence of (N)x comprises an antisense sequence substantially complementary to from about 18 to about 40 consecutive ribonucleotides in an mRNA of a target gene associated with an ear disorder.

In some embodiments of Structure (F), x=y=19 or x=y=23; (N')y comprises unmodified ribonucleotides in which two consecutive nucleotides at the 3' terminus comprises two consecutive mirror deoxyribonucleotides; and (N)x comprises unmodified ribonucleotides in which one nucleotide at the 3' terminus comprises a mirror deoxyribonucleotide (set forth as Structure III).

According to various embodiments of Structure (F) 2, 3, 4, 5, 6, 7, 8, 9, 10, 11, 12, 13 or 14 consecutive ribonucleotides independently beginning at the ultimate or penultimate position of the 3' termini of (N)x and (N')y are linked by 2'-5' internucleotide linkages. According to one preferred embodiment of Structure (F), three consecutive nucleotides at the 3' terminus of (N')y are joined by two 2'-5' phosphodiester bonds and three consecutive nucleotides at the 3' terminus of (N')x are joined by two 2'-5' phosphodiester bonds.

According to various embodiments of Structure (F), 2, 3, 4, 5, 6, 7, 8, 9, 10, 11, 12, 13 or 14 consecutive nucleotides independently beginning at the ultimate or penultimate position of the 3' termini of (N)x and (N')y are independently mirror nucleotides. In some embodiments the mirror nucleotide is an L-ribonucleotide. In other embodiments the mirror nucleotide is an L-deoxyribonucleotide.

In other embodiments of Structure (F), 2, 3, 4, 5, 6, 7, 8, 9, 10, 11, 12, 13 or 14 consecutive ribonucleotides independently beginning at the ultimate or penultimate position of the 3' termini of (N)x and (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In some embodiments of Structure (F), 2, 3, 4, 5, 6, 7, 8, 9, 10, 11, 12, 13 or 14 consecutive ribonucleotides independently beginning at the ultimate or penultimate position of the 3' termini of (N)x and (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments of Structure (F), (N')y comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 3' terminus or at both the 3' and 5' termini.

In various embodiments of Structure (F), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 3' terminus or at each of the 3' and 5' termini.

In one embodiment where each of 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (F), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having
Structure (G):

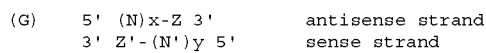

```
(G)    5' (N)x-Z 3'         antisense strand
       3' Z'-(N')y 5'        sense strand
``` wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is an integer between 18 and 40;

wherein each of (N)x and (N')y comprise unmodified ribonucleotides in which each of (N)x and (N')y independently comprise one modified nucleotide at the 5' terminal or penultimate position wherein the modified nucleotide is selected from the group consisting of a bicyclic nucleotide, a 2' sugar modified nucleotide, a mirror nucleotide, a nucleotide joined to an adjacent nucleotide by a P-alkoxy backbone modification or a nucleotide joined to an adjacent nucleotide by a 2'-5' phosphodiester bond;

wherein for (N)x the modified nucleotide is preferably at penultimate position of the 5' terminal;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of (N')y is a sequence substantially complementary to (N)x; and wherein the sequence of (N)x comprises an antisense sequence substantially complementary to from about 18 to about 40 consecutive ribonucleotides in an mRNA of a target gene associated with an ear disorder.

In some embodiments of Structure (G), x=y=19 or x=y=23.

According to various embodiments of Structure (G) 2, 3, 4, 5, 6, 7, 8, 9, 10, 11, 12, 13 or 14 consecutive ribonucleotides independently beginning at the ultimate or penultimate position of the 5' termini of (N)x and (N')y are linked by 2'-5' internucleotide linkages. For (N)x the modified nucleotides preferably starting at the penultimate position of the 5' terminal.

According to various embodiments of Structure (G), 2, 3, 4, 5, 6, 7, 8, 9, 10, 11, 12, 13 or 14 consecutive nucleotides independently beginning at the ultimate or penultimate position of the 5' termini of (N)x and (N')y are independently mirror nucleotides. In some embodiments the minor nucleotide is an L-ribonucleotide. In other embodiments the mirror nucleotide is an L-deoxyribonucleotide. For (N)x the modified nucleotides preferably starting at the penultimate position of the 5' terminal.

In other embodiments of Structure (G), 2, 3, 4, 5, 6, 7, 8, 9, 10, 11, 12, 13 or 14 consecutive ribonucleotides independently beginning at the ultimate or penultimate position of the 5' termini of (N)x and (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe). In some preferred embodiments the consecutive modified nucleotides preferably begin at the penultimate position of the 5' terminus of $(N)_x$.

In one preferred embodiment of Structure (G), five consecutive ribonucleotides at the 5' terminus of (N')y comprise a 2'OMe sugar modification and one ribonucleotide at the 5' penultimate position of (N')x comprises a 2'OMe sugar modification. In another preferred embodiment of Structure (G), five consecutive ribonucleotides at the 5' terminus of (N')y comprise 2'OMe sugar modification and two consecutive ribonucleotides at the 5' terminal position of (N')x comprise a 2'OMe sugar modification.

In some embodiments of Structure (G), 2, 3, 4, 5, 6, 7, 8, 9, 10, 11, 12, 13 or 14 consecutive ribonucleotides independently beginning at the ultimate or penultimate position of the 5' termini of (N)x and (N')y are bicyclic nucleotides. In various embodiments the bicyclic nucleotide is a locked nucleic acid (LNA) such as a 2'-O, 4'-C-ethylene-bridged nucleic acid (ENA). In some preferred embodiments the consecutive modified nucleotides preferably begin at the penultimate position of the 5' terminus of $(N)_x$.

In various embodiments of Structure (G), (N')y comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In various embodiments of Structure (G), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In one embodiment where each of 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond. In various embodiments of Structure (G), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (H):

```
(H)    5' (N)x-Z 3'         antisense strand
       3' Z'-(N')y 5'       sense strand
``` wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is an integer between 18 and 40;

wherein (N)x comprises unmodified ribonucleotides further comprising one modified nucleotide at the 3' terminal or penultimate position or the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein (N')y comprises unmodified ribonucleotides further comprising one modified nucleotide at an internal position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of (N')y is a sequence substantially complementary to (N)x; and wherein the sequence of $(N)_x$ comprises an antisense sequence substantially complementary to from about 18 to about 40 consecutive ribonucleotides in an mRNA of a target gene associated with an ear disorder.

In one embodiment of Structure (H), 2, 3, 4, 5, 6, 7, 8, 9, 10, 11, 12, 13 or 14 consecutive ribonucleotides independently beginning at the ultimate or penultimate position of the 3' terminus or the 5' terminus or both termini of (N)x are independently 2' sugar modified nucleotides, bicyclic nucleotides, mirror nucleotides, altritol nucleotides or nucleotides joined to an adjacent nucleotide by a 2'-5' phosphodiester bond and 2, 3, 4, 5, 6, 7, 8, 9, 10, 11, 12, 13 or 14 consecutive internal ribonucleotides in (N')y are independently 2' sugar modified nucleotides, bicyclic nucleotides, mirror nucleotides, altritol nucleotides or nucleotides joined to an adjacent nucleotide by a 2'-5' phosphodiester bond. In some embodiments the 2' sugar modification comprises the presence of an amino, a fluoro, an alkoxy or an alkyl moiety. In certain embodiments the 2' sugar modification comprises a methoxy moiety (2'-OMe).

In another embodiment of Structure (II), 2, 3, 4, 5, 6, 7, 8, 9, 10, 11, 12, 13 or 14 consecutive ribonucleotides independently beginning at the ultimate or penultimate position of the 3' terminus or the 5' terminus or 2-8 consecutive nucleotides at each of 5' and 3' termini of (N')y are independently 2' sugar modified nucleotides, bicyclic nucleotides, mirror nucleotides, altritol nucleotides or nucleotides joined to an adjacent nucleotide by a 2'-5' phosphodiester bond, and 2, 3, 4, 5, 6, 7, 8, 9, 10, 11, 12, 13 or 14 consecutive internal ribonucleotides in (N)x are independently 2' sugar modified nucleotides, bicyclic nucleotides, mirror nucleotides, altritol nucleotides or nucleotides joined to an adjacent nucleotide by a 2'-5' phosphodiester bond.

In one embodiment wherein each of 3' and 5' termini of the same strand comprises a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (H), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are minor nucleotides.

In one preferred embodiment of Structure (H), x=y=19; three consecutive ribonucleotides at the 9-11 nucleotide positions 9-11 of (N')y comprise 2'OMe sugar modification and five consecutive ribonucleotides at the 3' terminal position of (N')x comprise 2'OMe sugar modification.

For all the above Structures (A)-(H), in various embodiments x=y and each of x and y is 19, 20, 21, 22 or 23. In certain embodiments, x=y=19. In yet other embodiments x=y=23. In additional embodiments the compound comprises modified ribonucleotides in alternating positions wherein each N at the 5' and 3' termini of (N)x are modified in their sugar residues and the middle ribonucleotide is not modified, e.g. ribonucleotide in position 10 in a 19-mer strand, position 11 in a 21 mer and position 12 in a 23-mer strand.

In some embodiments where x=y=21 or x=y=23 the position of modifications in the 19 mer are adjusted for the 21 and 23 mers with the proviso that the middle nucleotide of the antisense strand is preferably not modified.

In some embodiments, neither (N)x nor (N')y are phosphorylated at the 3' and 5' termini. In other embodiments either or both (N)x and (N')y are phosphorylated at the 3' termini. In yet another embodiment, either or both (N)x and (N')y are phosphorylated at the 3' termini using non-cleavable phosphate groups. In yet another embodiment, either or both (N)x and (N')y are phosphorylated at the terminal 2' termini position using cleavable or non-cleavable phosphate groups. These particular siRNA compounds are also blunt ended and are non-phosphorylated at the termini; however, comparative experiments have shown that siRNA compounds phosphorylated at one or both of the 3'-termini have similar activity in vivo compared to the non-phosphorylated compounds.

In certain embodiments for all the above-mentioned Structures, the compound is blunt ended, for example wherein both Z and Z' are absent. In an alternative embodiment, the compound comprises at least one 3' overhang, wherein at least one of Z or Z' is present. Z and Z' independently comprises one or more covalently linked modified or non-modified nucleotides, for example inverted dT or dA; dT, LNA, mirror nucleotide and the like. In some embodiments each of Z and Z' are independently selected from dT and dTdT. siRNA in which Z and/or Z' is present have similar activity and stability as siRNA in which Z and Z' are absent.

In certain embodiments for all the above-mentioned Structures, the compound comprises one or more phosphonocarboxylate and/or phosphinocarboxylate nucleotides (PACE nucleotides). In some embodiments the PACE nucleotides are deoxyribonucleotides and the phosphinocarboxylate nucleotides are phosphinoacetate nucleotides. Examples of PACE nucleotides and analogs are disclosed in U.S. Pat. Nos. 6,693,187 and 7,067,641, both incorporated herein by reference.

In certain embodiments for all the above-mentioned Structures, the compound comprises one or more locked nucleic acids (LNA) also defined as bridged nucleic acids or bicyclic nucleotides. Preferred locked nucleic acids are 2'-O, 4'-C-ethylene nucleosides (ENA) or 2'-O, 4'-C-methylene nucleosides. Other examples of LNA and ENA nucleotides are disclosed in WO 98/39352, WO 00/47599 and WO 99/14226, all incorporated herein by reference.

In certain embodiments for all the above-mentioned Structures, the compound comprises one or more altritol monomers (nucleotides), also defined as 1,5 anhydro-2-deoxy-D-altrito-hexitol (see for example, Allart, et al., 1998. *Nucleosides & Nucleotides* 17:1523-1526; Herdewijn et al., 1999. *Nucleosides & Nucleotides* 18:1371-1376; Fisher et al., 2007, *NAR* 35(4):1064-1074; all incorporated herein by reference).

The present invention explicitly excludes compounds in which each of N and for N' is a deoxyribonucleotide (D-A, D-C, D-G, D-T). In certain embodiments (N)x and (N')y may comprise independently 1, 2, 3, 4, 5, 6, 7, 8, 9 or more deoxyribonucleotides. In certain embodiments the present invention provides a compound wherein each of N is an unmodified ribonucleotide and the 3' terminal nucleotide or 2, 3, 4, 5, 6, 7, 8, 9, 10, 11, 12, 13 or 14 consecutive nucleotides at the 3' terminus of (N')y are deoxyribonucleotides. In yet other embodiments each of N is an unmodified ribonucleotide and the 5' terminal nucleotide or 2, 3, 4, 5, 6, 7, 8, 9, 10, 11, 12, 13 or 14 consecutive nucleotides at the 5' terminus of (N')y are deoxyribonucleotides. In further embodiments the 5' terminal nucleotide or 2, 3, 4, 5, 6, 7, 8, or 9 consecutive nucleotides at the 5' terminus and 1, 2, 3, 4, 5, or 6 consecutive nucleotides at the 3' termini of (N)x are deoxyribonucleotides and each of N' is an unmodified ribonucleotide. In yet further embodiments (N)x comprises unmodified ribonucleotides and 1 or 2, 3 or 4 consecutive deoxyribonucleotides independently at each of the 5' and 3' termini and 1 or 2, 3, 4, 5 or 6 consecutive deoxyribonucleotides in internal positions; and each of N' is an unmodified ribonucleotide. In certain embodiments the 3' terminal nucleotide or 2, 3, 4, 5, 6, 7, 8, 9, 10, 11, 12 13 or 14 consecutive nucleotides at the 3' terminus of (N')y and the terminal 5' nucleotide or 2, 3, 4, 5, 6, 7, 8, 9, 10, 11, 12 13 or 14 consecutive nucleotides at the 5' terminus of (N)x are deoxyribonucleotides. The present invention excludes compounds in which each of N and/or N' is a deoxyribonucleotide. In some embodiments the 5' terminal nucleotide of N or 2 or 3 consecutive of N and 1, 2, or 3 of N' is a deoxyribonucleotide. Certain examples of active DNA/RNA siRNA chimeras are disclosed in US patent publication 2005/0004064, and Ui-Tei, 2008 (NAR 36(7):2136-2151) incorporated herein by reference in their entirety.

Unless otherwise indicated, in preferred embodiments of the structures discussed herein the covalent bond between each consecutive N or N' is a phosphodiester bond.

An additional novel molecule provided by the present invention is an oligonucleotide comprising consecutive nucleotides wherein a first segment of such nucleotides encode a first inhibitory RNA molecule, a second segment of such nucleotides encode a second inhibitory RNA molecule, and a third segment of such nucleotides encode a third inhibitory RNA molecule. Each of the first, the second and the third segment may comprise one strand of a double stranded RNA and the first, second and third segments may be joined together by a linker. Further, the oligonucleotide may comprise three double stranded segments joined together by one or more linker.

Thus, one molecule provided by the present invention is an oligonucleotide comprising consecutive nucleotides which encode three inhibitory RNA molecules; said oligonucleotide may possess a triple stranded structure, such that three double stranded arms are linked together by one or more linker, such as any of the linkers presented hereinabove. This molecule forms a "star"-like structure, and may also be referred to herein as RNAstar. Such structures are disclosed in PCT patent publication WO 2007/091269, assigned to the assignee of the present invention and incorporated herein in its entirety by reference.

A covalent bond refers to an internucleotide linkage linking one nucleotide monomer to an adjacent nucleotide monomer. A covalent bond includes for example, a phosphodiester bond, a phosphorothioate bond, a P-alkoxy bond, a P-carboxy bond and the like. The normal internucleoside linkage of RNA and DNA is a 3' to 5' phosphodiester linkage. In certain preferred embodiments a covalent bond is a phosphodiester bond. Covalent bond encompasses non-phosphorous-containing internucleoside linkages, such as those disclosed in WO 2004/041924 inter alia. Unless otherwise indicated, in preferred embodiments of the structures discussed herein the covalent bond between each consecutive N or N' is a phosphodiester bond.

For all of the structures above, in some embodiments the oligonucleotide sequence of (N)x is fully complementary to the oligonucleotide sequence of (N')y. In other embodiments (N)x and (N')y are substantially complementary. In certain embodiments (N)x is fully complementary to a target sequence. In other embodiments (N)x is substantially complementary to a target sequence.

In some embodiments, neither (N)x nor (N')y are phosphorylated at the 3' and 5' termini. In other embodiments either or both (N)x and (N')y are phosphorylated at the 3' termini (3' Pi). In yet another embodiment, either or both (N)x and (N')y are phosphorylated at the 3' termini with non-cleavable phosphate groups. In yet another embodiment, either or both (N)x and (N')y are phosphorylated at the terminal 2' termini position using cleavable or non-cleavable phosphate groups. Further, the inhibitory nucleic acid molecules of the present invention may comprise one or more gaps and/or one or more nicks and/or one or more mismatches. Without wishing to be bound by theory, gaps, nicks and mismatches have the advantage of partially destabilizing the nucleic acid/siRNA, so that it may be more easily processed by endogenous cellular machinery such as DICER, DROSHA or RISC into its inhibitory components.

In the context of the present invention, a gap in a nucleic acid refers to the absence of one or more internal nucleotides in one strand, while a nick in a nucleic acid refers to the absence of an internucleotide linkage between two adjacent nucleotides in one strand. Any of the molecules of the present invention may contain one or more gaps and/or one or more nicks.

In one aspect the present invention provides a compound having Structure (I):

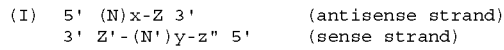

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present;

wherein z" may be present or absent, but if present is a capping moiety covalently attached at the 5' terminus of (N')y;

wherein x=18 to 27;
wherein y=18 to 27;

wherein (N)x comprises modified and unmodified ribonucleotides, each modified ribonucleotide having a 2'-O-methyl on its sugar, wherein N at the 3' terminus of (N)x is a modified ribonucleotide, (N)x comprises at least five alternating modified ribonucleotides beginning at the 3' end and at least nine modified ribonucleotides in total and each remaining N is an unmodified ribonucleotide;

wherein in (N')y at least one unconventional moiety is present, which unconventional moiety may be an abasic ribose moiety, an abasic deoxyribose moiety, a modified or unmodified deoxyribonucleotide, a minor nucleotide, and a nucleotide joined to an adjacent nucleotide by a internucleotide phosphate bond; and wherein the sequence of (N')$_y$ is a sequence substantially complementary to (N)x; and wherein the sequence of (N)$_x$ comprises an antisense sequence substantially complementary to from about 18 to about 40 consecutive ribonucleotides in an mRNA of a target gene associated with an ear disorder.

In some embodiments x=y=19. In other embodiments x=y=23. In some embodiments the at least one unconventional moiety is present at positions 15, 16, 17, or 18 in (N')y. In some embodiments the unconventional moiety is selected from a minor nucleotide, an abasic ribose moiety and an abasic deoxyribose moiety. In some preferred embodiments the unconventional moiety is a mirror nucleotide, preferably an L-DNA moiety. In some embodiments an L-DNA moiety is present at position 17, position 18 or positions 17 and 18.

In other embodiments the unconventional moiety is an abasic moiety. In various embodiments (N')y comprises at least five abasic ribose moieties or abasic deoxyribose moieties.

In yet other embodiments (N')y comprises at least five abasic ribose moieties or abasic deoxyribose moieties and at least one of N' is an LNA.

In some embodiments (N)x comprises nine alternating modified ribonucleotides. In other embodiments of Structure (I) (N)x comprises nine alternating modified ribonucleotides further comprising a 2'O modified nucleotide at position 2. In some embodiments (N)x comprises 2'O Me modified ribonucleotides at the odd numbered positions 1, 3, 5, 7, 9, 11, 13, 15, 17, 19. In other embodiments (N)x further comprises a 2'O Me modified ribonucleotide at one or both of positions 2 and 18. In yet other embodiments (N)x comprises 2'O Me modified ribonucleotides at positions 2, 4, 6, 8, 11, 13, 15, 17, 19.

In various embodiments z" is present and is selected from an abasic ribose moiety, a deoxyribose moiety; an inverted abasic ribose moiety, a deoxyribose moiety; C6-amino-Pi; a mirror nucleotide.

In another aspect the present invention provides a compound having Structure (J) set forth below:

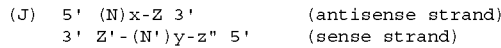

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present;

wherein z" may be present or absent but if present is a capping moiety covalently attached at the 5' terminus of (N')y;

wherein x=18 to 27;
wherein y=18 to 27;

wherein (N)x comprises modified or unmodified ribonucleotides, and optionally at least one unconventional moiety;

wherein in (N')y at least one unconventional moiety is present, which unconventional moiety may be an abasic ribose moiety, an abasic deoxyribose moiety, a modified or unmodified deoxyribonucleotide, a mirror nucleotide, a non-base pairing nucleotide analog or a nucleotide joined to an adjacent nucleotide by a 2'-5' internucleotide phosphate bond; and wherein the sequence of (N')$_y$ is a sequence substantially complementary to (N)x; and wherein the sequence of (N)$_x$ comprises an antisense sequence substantially complementary to from about 18 to about 40 consecutive ribonucleotides in an mRNA of a target gene associated with an ear disorder.

In some embodiments x=y=19. In other embodiments x=y=23. In some preferred embodiments (N)x comprises modified and unmodified ribonucleotides, and at least one unconventional moiety.

In some embodiments in (N)x the N at the 3' terminus is a modified ribonucleotide and (N)x comprises at least 8 modified ribonucleotides. In other embodiments at least 5 of the at least 8 modified ribonucleotides are alternating beginning at the 3' end. In some embodiments (N)x comprises an abasic moiety in one of positions 5, 6, 7, 8, 9, 10, 11, 12, 13, 14 or 15.

In some embodiments the at least one unconventional moiety in (N')y is present at positions 15, 16, 17, or 18. In some embodiments the unconventional moiety is selected from a mirror nucleotide, an abasic ribose moiety and an abasic deoxyribose moiety. In some preferred embodiments the unconventional moiety is a mirror nucleotide, preferably an L-DNA moiety. In some embodiments an L-DNA moiety is present at position 17, position 18 or positions 17 and 18. In other embodiments the at least one unconventional moiety in (N')y is an abasic ribose moiety or an abasic deoxyribose moiety.

In yet another aspect the present invention provides a compound having Structure (K) set forth below:

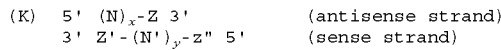

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present;

wherein z" may be present or absent but if present is a capping moiety covalently attached at the 5' terminus of (N')y;

wherein x=18 to 27;
wherein y=18 to 27;

wherein (N)x comprises a combination of modified or unmodified ribonucleotides and unconventional moieties, any modified ribonucleotide having a 2'-O-methyl on its sugar;

wherein (N')y comprises modified or unmodified ribonucleotides and optionally an unconventional moiety, any modified ribonucleotide having a 2'OMe on its sugar;

wherein the sequence of $(N')_y$ is a sequence substantially complementary to (N)x; and wherein the sequence of $(N)_x$ comprises an antisense sequence substantially complementary to from about 18 to about 40 consecutive ribonucleotides in an of a target gene associated with an ear disorder.

In some embodiments x=y=19. In other embodiments x=y=23. In some preferred embodiments the at least one preferred one unconventional moiety is present in (N)x and is an abasic ribose moiety or an abasic deoxyribose moiety. In other embodiments the at least one unconventional moiety is present in (N)x and is a non-base pairing nucleotide analog. In various embodiments (N')y comprises unmodified ribonucleotides. In some embodiments (N)x comprises at least five abasic ribose moieties or abasic deoxyribose moieties or a combination thereof. In certain embodiments (N)x and/or (N')y comprise modified ribonucleotides which do not base pair with corresponding modified or unmodified ribonucleotides in (N')y and/or $(N)_x$.

In various embodiments the present invention provides an siRNA set forth in Structure (L):

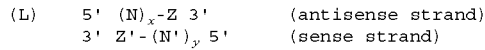

wherein each of N and N' is a nucleotide selected from an unmodified ribonucleotide, a modified ribonucleotide, an unmodified deoxyribonucleotide and a modified deoxyribonucleotide;

wherein each of $(N)_x$ and $(N')_y$ is an oligonucleotide in which each consecutive N or N' is joined to the next N or N' by a covalent bond;

wherein Z and Z' are absent;
wherein x=y=19;

wherein in (N')y the nucleotide in at least one of positions 15, 16, 17, 18 and 19 comprises a nucleotide selected from an abasic unconventional moiety, a mirror nucleotide, a deoxyribonucleotide and a nucleotide joined to an adjacent nucleotide by a 2'-5' internucleotide bond;

wherein (N)x comprises alternating 2'OMe sugar modified ribonucleotides and unmodified ribonucleotides so as to have 2'OMe sugar modified ribonucleotide at the middle position of (N)x; and wherein the sequence of $(N')_y$ is a sequence substantially complementary to (N)x; and wherein the sequence of $(N)_x$ comprises an antisense substantially complementary to from about 18 to about 40 consecutive ribonucleotides in an mRNA of a target gene associated with an ear disorder.

In some embodiments of Structure (L), in (N')y the nucleotide in one or both of positions 17 and 18 comprises a modified nucleotide selected from an abasic unconventional moiety, a mirror nucleotide and a nucleotide joined to an adjacent nucleotide by a 2'-5' internucleotide bond. In some embodiments the mirror nucleotide is selected from L-DNA and L-RNA. In various embodiments the mirror nucleotide is L-DNA.

In various embodiments (N')y comprises a modified nucleotide at position 15 wherein the modified nucleotide is selected from a mirror nucleotide and a deoxyribonucleotide.

In certain embodiments (N')y further comprises a modified nucleotide or pseudo nucleotide at position 2 wherein the pseudo nucleotide may be an abasic unconventional moiety and the modified nucleotide is optionally a mirror nucleotide.

In various embodiments the antisense strand (N)x comprises 2'O-Me modified ribonucleotides at the odd numbered positions (5' to 3'; positions 1, 3, 5, 7, 9, 11, 13, 15, 17, 19). In some embodiments (N)x further comprises 2'O-Me modified ribonucleotides at one or both positions 2 and 18. In other embodiments (N)x comprises 2'O Me modified ribonucleotides at positions 2, 4, 6, 8, 11, 13, 15, 17, 19.

Other embodiments of Structures (L) are envisaged wherein x=y=21 or wherein x=y=23; in these embodiments the modifications for (N')y discussed above instead of being in positions 17 and 18 are in positions 19 and 20 for 21-mer oligonucleotide and 21 and 22 for 23 mer oligonucleotide; similarly the modifications in positions 15, 16, 17, 18 or 19 are in positions 17, 18, 19, 20 or 21 for the 21-mer oligonucleotide and positions 19, 20, 21, 22, or 23 for the 23-mer oligonucleotide. The 2'O Me modifications on the antisense strand are similarly adjusted. In some embodiments (N)x comprises 2'O Me modified ribonucleotides at the odd numbered positions (5' to 3; positions 1, 3, 5, 7, 9, 12, 14, 16, 18, 20 for the 21 mer oligonucleotide [nucleotide at position 11 unmodified] and 1, 3, 5, 7, 9, 11, 13, 15, 17, 19, 21, 23 for the 23 mer oligonucleotide [nucleotide at position 12 unmodified]. In other embodiments (N)x comprises 2'O Me modified ribonucleotides at positions 2, 4, 6, 8, 10, 12, 14, 16, 18, 20 [nucleotide at position 11 unmodified for the 21 mer oligonucleotide and at positions 2, 4, 6, 8, 10, 13, 15, 17, 19, 21, 23 for the 23 mer oligonucleotide nucleotide at position 12 unmodified].

In some embodiments (N')y further comprises a 5' terminal cap nucleotide. In various embodiments the terminal cap moiety is selected from an abasic unconventional moiety, an inverted abasic unconventional moiety, an L-DNA nucleotide, and a C6-imine phosphate (C6 amino linker with phosphate at terminus).

In other embodiments the present invention provides a compound having Structure (M) set forth below:

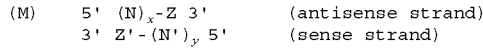

wherein each of N and N' is selected from a pseudo-nucleotide and a nucleotide;

wherein each nucleotide is selected from an unmodified ribonucleotide, a modified ribonucleotide, an unmodified deoxyribonucleotide and a modified deoxyribonucleotide;

wherein each of $(N)_x$ and $(N')_y$ is an oligonucleotide in which each consecutive N or N' is joined to the next N or N' by a covalent bond;

wherein Z and Z' are absent;

wherein x=18 to 27;
wherein y=18 to 27;
wherein the sequence of (N')_y is a sequence substantially complementary to (N)x; and wherein the sequence of (N)_x comprises an antisense sequence substantially complementary to from about 18 to about 40 consecutive ribonucleotides in an mRNA of a target gene associated with an ear disorder.

In other embodiments the present invention provides a double stranded compound having Structure (N) set forth below:

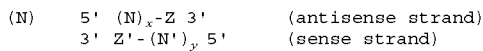

wherein each of N and N' is a nucleotide selected from an unmodified ribonucleotide, a modified ribonucleotide, an unmodified deoxyribonucleotide and a modified deoxyribonucleotide;
wherein each of (N)_x and (N')_y is an oligonucleotide in which each consecutive N or N' is joined to the next N or N' by a covalent bond;
wherein Z and Z' are absent;
wherein each of x and y is an integer between 18 and 40;
wherein the sequence of (N')_y is a sequence substantially complementary to (N)x; and wherein the sequence of (N)_x comprises an antisense sequence substantially complementary to from about 18 to about 40 consecutive ribonucleotides in an antisense sequence to the mRNA of a target gene associated with an ear disorder;
wherein (N)x, (N')y or (N)x and (N')y comprise non base-pairing modified nucleotides such that (N)x and (N')y form less than 15 base pairs in the double stranded compound.

In other embodiments the present invention provides a compound having Structure (O) set forth below:

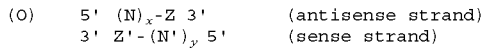

wherein each of N is a nucleotide selected from an unmodified ribonucleotide, a modified ribonucleotide, an unmodified deoxyribonucleotide and a modified deoxyribonucleotide;
wherein each of N' is a nucleotide analog selected from a six membered sugar nucleotide, seven membered sugar nucleotide, morpholino moiety, peptide nucleic acid and combinations thereof;
wherein each of (N)_x and (N')_y is an oligonucleotide in which each consecutive N or N' is joined to the next N or N' by a covalent bond;
wherein Z and Z' are absent;
wherein each of x and y is an integer between 18 and 40;
wherein the sequence of (N')_y is a sequence substantially complementary to (N)x; and wherein the sequence of (N)_x comprises an antisense sequence substantially complementary to from about 18 to about 40 consecutive ribonucleotides in an mRNA of a target gene associated with an ear disorder.

In other embodiments the present invention provides a compound having Structure (P) set forth below:

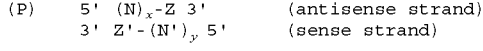

wherein each of N and N' is a nucleotide selected from an unmodified ribonucleotide, a modified ribonucleotide, an unmodified deoxyribonucleotide and a modified deoxyribonucleotide;
wherein each of (N)_x and (N')_y is an oligonucleotide in which each consecutive N or N' is joined to the next N or N' by a covalent bond;
wherein Z and Z' are absent;
wherein each of x and y is an integer between 18 and 40;
wherein one of N or N' in an internal position of (N)x or (N')y or one or more of N or N' at a terminal position of (N)x or (N')y comprises an abasic moiety or a 2' modified nucleotide;
wherein the sequence of (N')_y is a sequence substantially complementary to (N)x; and wherein the sequence of (N)_x comprises an antisense sequence substantially complementary to from about 18 to about 40 consecutive ribonucleotides in an mRNA of a target gene associated with an ear disorder.

In various embodiments (N')y comprises a modified nucleotide at position 15 wherein the modified nucleotide is selected from a mirror nucleotide and a deoxyribonucleotide.

In certain embodiments (N')y further comprises a modified nucleotide at position 2 wherein the modified nucleotide is selected from a mirror nucleotide and an abasic unconventional moiety.

In various embodiments the antisense strand (N)x comprises 2'O-Me modified ribonucleotides at the odd numbered positions (5' to 3'; positions 1, 3, 5, 7, 9, 11, 13, 15, 17, 19). In some embodiments (N)x further comprises 2'O-Me modified ribonucleotides at one or both positions 2 and 18. In other embodiments (N)x comprises 2'O Me modified ribonucleotides at positions 2, 4, 6, 8, 11, 13, 15, 17, 19.

An additional novel molecule provided by the present invention is an oligonucleotide comprising consecutive nucleotides wherein a first segment of such nucleotides encode a first inhibitory RNA molecule, a second segment of such nucleotides encode a second inhibitory RNA molecule, and a third segment of such nucleotides encode a third inhibitory RNA molecule. Each of the first, the second and the third segment may comprise one strand of a double stranded RNA and the first, second and third segments may be joined together by a linker. Further, the oligonucleotide may comprise three double stranded segments joined together by one or more linker.

Thus, one molecule provided by the present invention is an oligonucleotide comprising consecutive nucleotides which encode three inhibitory RNA molecules; said oligonucleotide may possess a triple stranded structure, such that three double stranded arms are linked together by one or more linker, such as any of the linkers presented hereinabove. This molecule forms a "star"-like structure, and may also be referred to herein as RNAstar.

Said triple-stranded oligonucleotide may be an oligoribonucleotide having the general structure;

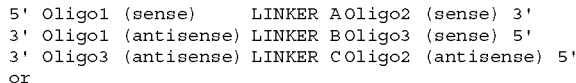
or

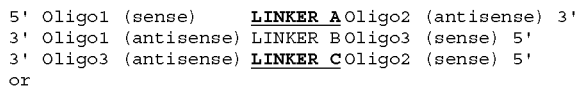
or

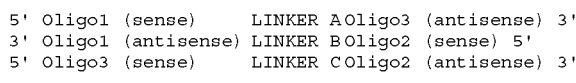

wherein one or more of linker A, linker B or linker C is present; any combination of two or more oligonucleotides and one or more of linkers A-C is possible, so long as the polarity of the strands and the general structure of the molecule remains. Further, if two or more of linkers A-C are present, they may be identical or different.

Thus, a triple-armed structure is formed, wherein each arm comprises a sense strand and complementary antisense strand (i.e. Oligo1 antisense base pairs to Oligo1 sense etc.). The triple armed structure may be triple stranded, whereby each arm possesses base pairing.

Further, the above triple stranded structure may have a gap instead of a linker in one or more of the strands. Such a molecule with one gap is technically quadruple stranded and not triple stranded; inserting additional gaps or nicks will lead to the molecule having additional strands. Preliminary results obtained by the inventors of the present invention indicate that said gapped molecules are more active in inhibiting certain target genes than the similar but non-gapped molecules. This may also be the case for nicked molecules.

According to one preferred embodiment of the invention, the antisense and the sense strands of the siRNA are phosphorylated only at the 3'-terminus and not at the 5'-terminus. According to another preferred embodiment of the invention, the antisense and the sense strands are non-phosphorylated. According to yet another preferred embodiment of the invention, the 5' most ribonucleotide in the sense strand is modified to abolish any possibility of in vivo 5'-phosphorylation.

The invention further provides a vector capable of expressing any of the aforementioned oligoribonucleotides in unmodified form in a cell after which appropriate modification may be made. In preferred embodiment the cell is a mammalian cell, preferably a human cell.

Pharmaceutical Compositions

The inventors of the present invention have overcome many of the obstacles in development of a composition for delivery of a therapeutic oligonucleotide to the middle and inner ear. Accordingly the present invention provides a pharmaceutical composition comprising one or more inhibitory oligonucleotide compounds; a permeability enhancer and a pharmaceutically acceptable vehicle or carrier. In some embodiments the composition comprises a mixture of two or more different oligonucleotides/siRNA compound.

A "penetration enhancer" or "permeability enhancer" includes a polyol such as polyethylene glycol (PEG), glycerol (glycerin), maltitol, sorbitol etc.; diethylene glycol monoethyl ether, azone, benzalkonium chloride (ADBAC), cetylperidium chloride, cetylmethylammonium bromide, dextran sulfate, lauric acid, menthol, methoxysalicylate, oleic acid, phosphatidylcholine, polyoxyethylene, polysorbate 80, sodium glycholate, sodium lauryl sulfate, sodium salicylate, sodium taurocholate, sodium taurodeoxycholate, sulfoxides, sodium deoxycholate, sodium glycodeoxycholate, sodium taurocholate and surfactants such as sodium lauryl sulfate, laureth-9, cetylpyridinium chloride and polyoxyethylene monoalkyl ethers, benzoic acids, such as sodium salicylate and methoxy salicylate, fatty acids, such as lauric acid, oleic acid, undecanoic acid and methyl oleate, fatty alcohols, such as octanol and nonanol, laurocapram, cyclodextrins, thymol, limonene, urea, chitosan and other natural and synthetic polymers.

Suitable polyols for inclusion in the solutions of the invention include glycerol and sugar alcohols such as sorbitol, mannitol or xylitol, polyethylene glycol and derivatives thereof. In some embodiments the composition further includes a preservative. Accepted preservatives such as benzalkonium chloride and disodium edetate (EDTA) are included in the compositions of the invention in concentrations sufficient for effective antimicrobial action, about 0.0001 to 0.1%, based on the weight of the composition.

The invention further provides a pharmaceutical composition comprising at least one compound of the invention covalently or non-covalently bound to one or more compounds of the invention in an amount effective to inhibit one or more genes as disclosed above; and a pharmaceutically acceptable carrier. In some embodiments the compound is processed intracellularly by endogenous cellular complexes to produce one or more oligoribonucleotides of the invention.

Additionally, the invention provides a method of inhibiting the expression of a target gene, by at least 50% as compared to a control, comprising contacting an mRNA transcript of the target gene with composition of the invention. In some embodiments an active siRNA compound inhibits gene expression at a level of at least 50%, 60% or 70% as compared to control. In certain preferred embodiments inhibition is at a level of at least 75%, 80% or 90% as compared to control. In some embodiments the target gene is a human gene as disclosed herein.

In one embodiment the oligoribonucleotide inhibits one or more of the genes as disclosed in the present invention, whereby the inhibition is selected from the group comprising inhibition of gene function, inhibition of polypeptide and inhibition of mRNA expression. In certain embodiments, the target gene is a viral, bacterial or mammalian gene. In various embodiments the target gene is a mammalian gene, preferably a human gene. In some embodiments the target gene having an mRNA selected from any one of SEQ ID NO: 1-SEQ ID NO:36.

In one embodiment the compound inhibits expression of a polypeptide encoded by a target gene whereby the inhibition is selected from the group comprising inhibition of function (which may be examined by an enzymatic assay or a binding assay with a known interactor of the native gene/polypeptide, inter alia), inhibition of protein (which may be examined by Western blotting, ELISA or immuno-precipitation, inter ado) and inhibition of mRNA expression (which may be examined by Northern blotting, quantitative RT-PCR, in-situ hybridisation or microarray hybridisation, inter alia).

In additional embodiments the invention provides a method of treating a subject suffering from a disease accompanied by an elevated level a gene of the present invention, the method comprising administering to the subject a compound of the invention in a therapeutically effective dose thereby treating the subject.

Delivery

The siRNA molecules of the present invention is delivered to the ear by direct application of pharmaceutical composition to the outer ear. In some embodiments the pharmaceutical composition is applied to the ear canal. Delivery to the ear may also be refereed to as aural or otic delivery comprising siRNA; a penetration enhancer and a pharmaceutically acceptable vehicle.

In some embodiments the siRNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference.

Delivery systems aimed specifically at the enhanced and improved delivery of siRNA into mammalian cells have been developed, (see, for example, Shen et al FEBS Let. 2003, 539:111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-

2724). siRNA has recently been successfully used for inhibition of gene expression in primates (see for example. Tolentino et al., Retina 24(4):660.

The "therapeutically effective dose" for purposes herein is thus determined by such considerations as are known in the art. The dose must be effective to achieve improvement including but not limited to improved survival rate or more rapid recovery, or improvement or elimination of symptoms and other indicators as are selected as appropriate measures by those skilled in the art.

In general, the active dose of compound for humans is in the range of from 1 ng/kg to about 20-100 mg/kg body weight per day, preferably about 0.01 mg to about 2-10 mg/kg body weight per day, in a regimen of one dose per day or twice or three or more times per day for a period of 1-4 weeks or longer. In various embodiments the siRNA is chemically modified to increase stability, increase activity, reduce off target effects, and or to reduce innate immune stimulation. Dosage to the ear is determined, inter alia, by the activity of the oligonucleotide, the indication and the severity of the disorder and comprises administering a dose of about 0.1 ng to about 10 mg, about 1 ng to about 1 mg, or about 10 ng to about 1 mg, total oligonucleotide in pharmaceutically acceptable agent. The concentration of siRNA in the composition is between 0.1 mg/ml to 100 mg/ml, preferably between 1 mg/ml to 100 mg/ml, and more preferably between 5 mg/ml to 20 mg/ml.

The compounds of the present invention are administered by topical administration. It should be noted that the compound can be administered as the compound or as pharmaceutically acceptable salt and can be administered alone or as an active ingredient in combination with pharmaceutically acceptable carriers, solvents, diluents, excipients, adjuvants and vehicles. The compounds are administered as eardrops, ear cream, ear ointment, foam, mousse or any of the above in combination with a delivery device. Implants of the compounds are also useful. Liquid forms are prepared as drops. The liquid compositions include aqueous solutions, with and without organic co-solvents, aqueous or oil suspensions, emulsions with edible oils, as well as similar pharmaceutical vehicles. In another embodiment the administration comprises non-invasive topical or local administration. Eardrops may also be referred to as otic drops or aural drops. In a preferred embodiment, the ear drops remain in the ear canal for about 30 min in order to prevent leakage of the drops out of the canal. It is thus preferable that the subject receiving the drops keep his head on the side with the treated ear facing upward to prevent leakage of the drop out of the canal.

In preferred embodiments the subject being treated is a warm-blooded animal and, in particular, mammals including human.

Methods of Treatment

In another aspect, the present invention relates to a method for the treatment of a subject in need of treatment for an ear disease or disorder associated with the abnormal expression of a target gene, comprising administering to the subject an amount of an oligonucleotide which reduces or inhibits expression of a target gene associated with the ear disorder in a pharmaceutical composition comprising the oligonucleotide, a permeability enhancer and a pharmaceutically acceptable carrier. In some embodiments the target gene is listed in Table 1. In a preferred embodiment, the target gene is selected from one or more of: TP53BP2 (ASPP2), BNIP3, CASP2, NOX3, HRK, RAC1, DDIT4, DDIT4L, NOX4, HTRA2, CAPNS1 (Calpain), ID3, HES1, HES5, CDKN1B and ID3.

In preferred embodiments the subject being treated is a warm-blooded animal and, in particular, mammals including human.

The methods of the invention comprise administering to the subject a pharmaceutical composition comprising one or more inhibitory compounds which down-regulate expression of a gene associated with an ear disorder; and a pharmaceutically acceptable vehicle, in a therapeutically effective dose so as to thereby treat the subject.

The term "treatment" refers to both therapeutic treatment and prophylactic or preventative measures, wherein the object is to prevent or slow down (lessen) the ear disorder. Those in need of treatment include those already experiencing the disease or condition, those prone to having the disease or condition, and those in which the disease or condition is to be prevented. The compounds of the invention may be administered before, during or subsequent to the onset of the disease or condition or symptoms associated therewith. In cases where treatment is for the purpose of prevention, then the present invention relates to a method for delaying the onset of or averting the development of the disease or disorder. In some embodiments the method comprises administering eardrops which are warmed to 35° C. to about 38° C. to the subject's ear. In some embodiments the method of comprises administering the composition of the present invention unilaterally, e.g. to one of the subject's ear. In various embodiments the composition is allowed to penetrate the subject's ear for about 5 minutes to about 60 minutes.

One aspect of the present invention relates to combination therapy. The active ingredients that comprise a combination therapy may be administered together via a single dosage form or by separate administration of each active agent. In some embodiments the combination therapy comprises administering to a subject in need thereof a composition according to the present invention and an ototoxin. For example, the present invention is directed to an improved method for treatment of hearing loss in a mammal comprising co-administering to the mammal an ototoxin and a therapeutically effective amount of one or more compounds of the present invention. Ototoxic agents include cisplatin and cisplatin-like compounds, aminoglycosides, loop diuretics, and hydroquinone and their analogs.

Co-administration comprises administering two or more agents, each of which is formulated and administered separately, or by administering two or more agents in a single formulation. While the two or more agents can be administered simultaneously, they need not be. For example, administration of a first agent (or combination of agents) can precede administration of a second agent (or combination of agents) by minutes, hours, days, or weeks. Thus, the two or more agents can be administered within minutes of each other or within any number of hours of each other or within any number or days or weeks of each other. In some cases even longer intervals are possible.

Methods, molecules and compositions, which inhibit the genes of the invention, are discussed herein at length, and any of said molecules and/or compositions may be beneficially employed in the treatment of a subject suffering from any of said conditions.

The present invention also provides for a process of preparing a pharmaceutical composition, which comprises:
providing one or more compounds of the invention; and
admixing said compound with a pharmaceutically acceptable carrier.

The present invention also provides for a process of preparing a pharmaceutical composition, which comprises admixing one or more compounds of the present invention with a pharmaceutically acceptable carrier.

In a preferred embodiment, the compound used in the preparation of a pharmaceutical composition is admixed with a carrier in a pharmaceutically effective dose. In a particular embodiment the compound of the present invention is conjugated to a steroid or to a lipid or to another suitable molecule e.g. to cholesterol.

Oligonucleotide Synthesis

The compounds of the present invention can be synthesized by any of the methods that are well-known in the art for synthesis of ribonucleic (or deoxyribonucleic) oligonucleotides. Such synthesis is, among others, described in Beaucage and Iyer, Tetrahedron 1992; 48:2223-2311: Beaucage and Iyer. Tetrahedron 1993; 49: 6123-6194 and Caruthers, et. al., Methods Enzymol. 1987; 154: 287-313; the synthesis of thioates is, among others, described in Eckstein, Annu. Rev. Biochem. 1985; 54: 367-402, the synthesis of RNA molecules is described in Sproat, in Humana Press 2005 edited by Herdewijn P.; Kap. 2: 17-31 and respective downstream processes are, among others, described in Pingoud et. al., in IRE Press 1989 edited by Oliver R. W. A.; Kap. 7: 183-208.

Other synthetic procedures are known in the art e.g. the procedures as described in Usman et al., J. Am. Chem. Soc., 1987, 109:7845; Scaringe et al., NAR, 1990, 18:5433; Wincott et al., NAR 1995, 23:2677-2684; and Wincott et al., Methods Mol. Bio., 1997, 74:59, and these procedures may make use of common nucleic acid protecting and coupling groups, such as dimethoxytrityl at the 5'-end, and phosphoramidites at the 3'-end. The modified (e.g. 2'-O-methylated) nucleotides and unmodified nucleotides are incorporated as desired.

The oligonucleotides of the present invention can be synthesized separately and joined together post-synthetically, for example, by ligation (Moore et al., Science 1992, 256:9923; International Patent Publication No. WO 93/23569; Shabarova et al., NAR 1991, 19:4247; Bellon et al., Nucleosides & Nucleotides, 1997, 16:951; Bellon et al., Bioconjugate Chem 1997, 8:204), or by hybridization following synthesis and/or deprotection.

It is noted that a commercially available machine (available, inter alia, from Applied Biosystems) can be used; the oligonucleotides are prepared according to the sequences disclosed herein. Overlapping pairs of chemically synthesized fragments can be ligated using methods well known in the art (e.g., see U.S. Pat. No. 6,121,426). The strands are synthesized separately and then are annealed to each other in the tube. Then, the double-stranded siRNAs are separated from the single-stranded oligonucleotides that were not annealed (e.g. because of the excess of one of them) by HPLC. In relation to the siRNAs or siRNA fragments of the present invention, two or more such sequences can be synthesized and linked together for use in the present invention.

The compounds of the invention can also be synthesized via tandem synthesis methodology, as described for example in US Patent Publication No. 2004/0019001 (McSwiggen), wherein both siRNA strands are synthesized as a single contiguous oligonucleotide fragment or strand separated by a cleavable linker which is subsequently cleaved to provide separate siRNA fragments or strands that hybridize and permit purification of the siRNA duplex. The linker can be a polynucleotide linker or a non-nucleotide linker.

The present invention further provides for a pharmaceutical composition comprising two or more siRNA molecules for the treatment of any of the diseases and conditions mentioned herein, whereby said two molecules may be physically mixed together in the pharmaceutical composition in amounts which generate equal or otherwise beneficial activity, or may be covalently or non-covalently bound, or joined together by a nucleic acid linker of a length ranging from 2-100, preferably 2-50 or 2-30 nucleotides.

Thus, the siRNA molecules may be covalently or non-covalently bound or joined by a linker to form a tandem siRNA compound. Such tandem siRNA compounds comprising two siRNA sequences are typically about 38-150 nucleotides in length, more preferably 38 or 40-60 nucleotides in length, and longer accordingly if more than two siRNA sequences are included in the tandem molecule. A longer tandem compound comprised of two or more longer sequences which encode siRNA produced via internal cellular processing, e.g., long dsRNAs, is also envisaged, as is a tandem molecule encoding two or more shRNAs. Such tandem molecules are also considered to be a part of the present invention. A tandem compound comprising two or more siRNAs sequences of the invention is envisaged.

An siRNA molecule that targets a gene associated with an ear disorder may be the main active component in a pharmaceutical composition, or may be one active component of a pharmaceutical composition containing two or more siRNAs (or molecules which encode or endogenously produce two or more siRNAs, be it a mixture of molecules or one or more tandem molecules which encode two or more siRNAs), said pharmaceutical composition further being comprised of one or more additional siRNA molecule which targets one or more additional gene. Simultaneous inhibition of said additional gene(s) will likely have an additive or synergistic effect for treatment of the diseases disclosed herein.

Additionally, the siRNA disclosed herein or any nucleic acid molecule comprising or encoding such siRNA can be linked or bound (covalently or non-covalently) to antibodies (including aptamer molecules) against cell surface internalizable molecules expressed on the target cells, in order to achieve enhanced targeting for treatment of the diseases disclosed herein. For example, anti-Pas antibody (preferably a neutralizing antibody) may be combined (covalently or non-covalently) with any other siRNA.

The compounds of the present invention can be delivered for example as double stranded compounds, as double stranded hairpin compounds or as tandem compounds. It is also envisaged that a long oligonucleotide (typically 25-500 nucleotides in length) comprising one or more stem and loop structures, where stem regions comprise the sequences of the oligonucleotides of the invention, may be delivered in a carrier, preferably a pharmaceutically acceptable carrier, and may be processed intracellularly by endogenous cellular complexes (e.g. by DROSHA and DICER as described above) to produce one or more smaller double stranded oligonucleotides (siRNAs) which are oligonucleotides of the invention. This oligonucleotide can be termed a tandem shRNA construct. It is envisaged that this long oligonucleotide is a single stranded oligonucleotide comprising one or more stem and loop structures, wherein each stem region comprises a sense and corresponding antisense siRNA sequence of the genes of the invention. In particular, it is envisaged that this oligonucleotide comprises an antisense sequence $(N)_x$ relative to the mRNA transcribed from a mammalian gene selected from the group set forth in Table 1. In a preferred embodiment, the target gene is selected from one or more of: TP53BP2 (ASPP2), BNIP3, CASP2, NOX3, HRK, RAC1, DDIT4, DDIT4L, NOX4, HTRA2, CAPNS1 (Calpain), ID3, HES1, HES5, CDKN1B and ID3.

A number of PCT applications have recently been published that relate to the RNAi phenomenon. These include: PCT publication WO 00/44895; PCT publication WO 00/49035; PCT publication WO 00/63364; PCT publication WO 01/36641; PCT publication WO 01/36646; PCT publication WO 99/32619; PCT publication WO 00/44914; PCT publication WO 01/29058; and PCT publication WO 01/75164.

RNA interference (RNAi) is based on the ability of dsRNA species to enter a cytoplasmic protein complex, where it is then targeted to the complementary cellular RNA and specifically degrade it. The RNA interference response features an endonuclease complex containing an siRNA, commonly referred to as an RNA-induced silencing complex (RISC), which mediates cleavage of single-stranded RNA having a sequence complementary to the antisense strand of the siRNA duplex. Cleavage of the target RNA may take place in the middle of the region complementary to the antisense strand of the siRNA duplex (Elbashir et al., Genes Dev., 2001, 15(2): 188-200). In more detail, longer dsRNAs are digested into short (17-29 bp) dsRNA fragments (also referred to as short inhibitory RNAs, "siRNAs") by type III RNAses (DICER, DROSHA, etc.; Bernstein et al., Nature, 2001, 409(6818): 363-6; Lee et al., Nature, 2003, 425(6956):415-9). The RISC protein complex recognizes these fragments and complementary mRNA. The whole process is culminated by endonuclease cleavage of target mRNA (McManus & Sharp, Nature Rev Genet, 2002, 3(10):737-47; Paddison & Hannon, Curr Opin Mol. Ther. 2003, 5(3):217-24). (For additional information on these terms and proposed mechanisms, see for example Bernstein et al., RNA 2001, 7(11):1509-21; Nishikura, Cell 2001, 107(4):415-8 and PCT publication WO 01/36646).

Several groups have described the development of DNA-based vectors capable of generating siRNA within cells. The method generally involves transcription of short hairpin RNAs that are efficiently processed to form siRNAs within cells (Paddison et al. PNAS USA 2002, 99:1443-1448; Paddison et al. Genes & Dev 2002, 16:948-958; Sui et al, PNAS USA 2002, 8:5515-5520; and Brummelkamp et al. Science 2002, 296:550-553). These reports describe methods to of generate generating siRNAs capable of specifically targeting numerous endogenously and exogenously expressed genes.

The invention has been described in an illustrative manner, and it is to be understood that the terminology used is intended to be in the nature of words of description rather than of limitation.

Obviously, many modifications and variations of the present invention are possible in light of the above teachings. It is, therefore, to be understood that within the scope of the appended claims, the invention can be practiced otherwise than as specifically described. Throughout this application, various publications, including United States patents, are referenced by author and year and patents by number. The disclosures of these publications and patents and patent applications in their entireties are hereby incorporated by reference into this application in order to more fully describe the state of the art to which this invention pertains.

The present invention is illustrated in detail below with reference to examples, but is not to be construed as being limited thereto.

Citation of any document herein is not intended as an admission that such document is pertinent prior art, or considered material to the patentability of any claim of the present application. Any statement as to content or a date of any document is based on the information available to applicant at the time of filing and does not constitute an admission as to the correctness of such a statement.

EXAMPLES

Without further elaboration, it is believed that one skilled in the art can, using the preceding description, utilize the present invention to its fullest extent. The following preferred specific embodiments are, therefore, to be construed as merely illustrative, and not limitative of the claimed invention in any way.

Material and Methods: General

Standard molecular biology protocols known in the art not specifically described herein are generally followed essentially as in Sambrook et al., *Molecular cloning: A laboratory manual*, Cold Springs Harbor Laboratory, New-York (1989, 1992), and in Ausubel et al., *Current Protocols in Molecular Biology*, John Wiley and Sons, Baltimore, Md. (1988), and as in Ausubel et al., *Current Protocols in Molecular Biology*, John Wiley and Sons, Baltimore, Md. (1989) and as in Perbal, A Practical Guide to Molecular Cloning, John Wiley & Sons, New York (1988), and as in Watson et al., Recombinant DNA, Scientific American Books, New York and in Birren et al (eds) Genome Analysis: A Laboratory Manual Series, Vols. 1-4 Cold Spring Harbor Laboratory Press, New York (1998) and methodology as set forth in U.S. Pat. Nos. 4,666,828; 4,683,202; 4,801,531; 5,192,659 and 5,272,057 and incorporated herein by reference. Polymerase chain reaction (PCR) was carried out generally as in PCR Protocols: A Guide To Methods And Applications, Academic Press, San Diego, Calif. (1990). In situ (In cell) PCR in combination with Flow Cytometry can be used for detection of cells containing specific DNA and mRNA sequences (Testoni et al., Blood 1996, 87:3822.) Methods of performing RT-PCR are also well known in the art.

Cell Culture:

HeLa cells (American Type Culture Collection) were cultured as described in Czauderna, et al. (NAR, 2003, 31:670-82). Human keratinocytes were cultured at 37° C. in Dulbecco's modified Eagle medium (DMEM) containing 10% FCS. The mouse cell line, B16V (American Type Culture Collection), was cultured at 37° C. in Dulbecco's modified Eagle medium (DMEM) containing 10% FCS. Culture conditions were as described in (Methods Find Exp Clin Pharmacol. 1997 May; 19(4):231-9). In each case, the cells were subject to the experiments as described herein at a density of about 50,000 cells per well and the double-stranded nucleic acid according to the present invention was added at 20 nM, whereby the double-stranded nucleic acid was complexed using 1 μg/ml of a proprietary lipid as described below.

Induction of Hypoxia-Like Conditions:

Where required, cells were treated with $CoCl_2$ for inducing a hypoxia-like condition as follows: siRNA transfections were carried out in 10-cm plates (30-50% confluency) as described by Czanderna et al., 2003; Kretschmer et al., 2003. Briefly, siRNA were transfected by adding a preformed 10× concentrated complex of GB and lipid in serum-free medium to cells in complete medium. The total transfection volume was 10 ml. The final lipid concentration was 1.0 μg/ml; the final siRNA concentration was 20 nM unless otherwise stated. Induction of the hypoxic responses was carried out by adding $CoCl_2$ (100 μM) directly to the tissue culture medium 24 h before lysis.

Preparation of Cell Extracts and Immuno Blotting

The preparation of cell extracts and immuno blot analysis were carried out essentially as described (Klippel et al. Mol Cell Biol, 1998. 18:5699-711; Klippel, A., et al., Mol Cell Biol, 1996. 16:4117-27).

Example 1

In Vitro Testing of siRNA Compounds

About $1.5\text{-}2\times10^5$ tested cells (HeLa cells and/or 2931 cells for siRNA targeting human genes and NRK52 cells and/or NMUMG cells for siRNA targeting the rat/mouse gene) were seeded per well in a 6 well plate (70-80% confluent).

24 hours later, cells were transfected with siRNA compounds using the Lipofectamine™ 2000 reagent (Invitrogen) at final concentrations of 5 nM or 20 nM. The cells were incubated at 37° C. in a $CO_2$ incubator for 72 hours.

As positive control for transfection PTEN-Cy3 labeled siRNA compounds were used. An additional positive control used was a blunt-ended 19-mer siRNA, i.e. x=y=19 wherein Z and Z' are both absent. This siRNA was non-phosphorylated and had alternating ribonucleotides modified at the 2' position of the sugar residue in both the antisense and the sense strands, wherein the moiety at the 2' position is methoxy (2'OMe) and wherein the ribonucleotides at the 5' and 3' termini of the antisense strand are modified in their sugar residues, and the ribonucleotides at the 5' and 3' termini of the sense strand are unmodified in their sugar residues.

As negative control for siRNA activity GFP siRNA compounds were used.

At 72 hours after transfection the cells were harvested and RNA is extracted from the cells. Transfection efficiency was tested by fluorescent microscopy.

The percent of inhibition of gene expression using specific preferred siRNA structures is determined using qPCR analysis of a target gene in cells expressing the endogenous gene. In general, the siRNAs having specific sequences that were selected for in vitro testing were specific for human and a second species such as rat or rabbit genes. In some examples, similar results are obtained using siRNAs having these RNA sequences and modified as described herein. The siRNA oligomers tested herein are selected from siRNA compounds comprising oligonucleotides in FIG. 4, from Tables B of U.S. Ser. No. 11/978,089, which are hereby incorporated by reference in their entirety and are set forth as SEQ ID NOS:97-68654. The siRNA oligomers tested herein are also disclosed in U.S. Ser. Nos. or PCT application Ser. Nos. 11/207,119, 11/811,112, 11/655,636, PCT/IL2008/000797, PCT/IL2008/000874, PCT/IL2009/000053, PCT/IL2009/000302 which are hereby incorporated by reference in their entirety.

Example 2

Middle/Inner Ear Delivery Routes of Cy3 Labelled DDIT4_1 siRNA

The objectives of the study were as follows: To establish procedures for topical, non-invasive delivery of a therapeutic oligonucleotide to the middle/inner ear.

To estimate the temporal pattern of distribution of siRNA DDIT4-Cy3 into cochlear structures, following instillation of pharmaceutical compositions into right external auditory canal in rats (REAC).

The substance tested was Cy3-labeled siRNA against RTP801 (DDIT4_1-Cy3) (sense strand: GUGCCAAC-CUGAUGCAGCU (SEQ ID NO:5843); antisense strand: AGCUGCAUCAGGUUGGCAC (SEQ ID NO:5844)).

Description of the test material: double-stranded Cy3-labeled 19-mer siRNA, Cy3 is linked to the 3' end of the antisense strand via a dT nucleotide. Both sense and anti-sense strands harbor alternating 2'-OMe modifications on every odd nucleotide of the anti-sense strand and on every even nucleotide of the sense strand. Under sterile conditions, 42.43 mg of DD1T4_1-Cy3 powder (BioSpring) were dissolved in 2.1 ml of sterile double distilled water, to achieve clear 20 mg/ml (1.5 mM) solution. The solution was stored at −80° C. until use. Formulated (formulated compound) sterile 10 mg/ml Cy3DDIT4_1 in 20% sterile glycerol solution in pyrogen free water.

Control Article(s) (including positive/negative controls and vehicle)

Vehicle—20% sterile glycerol solution in pyrogen free water.

Test system: Male rats, 10-14 weeks old, weighing 200-220 gr

Experimental design: The study included 5 experimental groups as described in Table 2, below: Experimental groups I-IV (treated with siRNA (DDIT4_1-Cy3) glycerol based eardrop/3 rats/time point) and group V (a; b and c)-3 rats/time point (20% glycerol treated control group). Rats were treated with a single siRNA (DD1T4_1-Cy3) glycerol based or 20% glycerol only eardrop (warmed to 37° C.; only one ear treated: a.d.=aurio dexrta=right ear (right external auditory canal: REAC)/a.s. aurio sinister left ear was used as non-treated control) as follows:

Groups I-IV: dose regime: 100 µg/10 µl/ear of 20% glycerol/time point, administration route: REAC 3 rats per time point.

Group V (a-c): REAC 10 µl 20% glycerol only treated control.

TABLE 2

Study Design

| Group | SiRNA Type | Dose µg/rat | Volume (µl) | Route | Time point (Days) | Group Size |
|---|---|---|---|---|---|---|
| I | DDIT4_1-Cy3 | 100 µg | 10.00 | REAC | 1 | 3 |
| II | DDIT4_1-Cy3 | 100 µg | 10.00 | REAC | 3 | 3 |
| III | DDIT4_1-Cy3 | 100 µg | 10.00 | REAC | 7 | 3 |
| IV | DDIT4_1-Cy3 | 100 µg | 10.00 | REAC | 14 | 3 |
| V (a, b, c) | Glycerol 20% | none | 10.00 | REAC | 3; 7; 14 | 3 × 3 |

Preparation of test and control articles for administration: One (1) ml of 100% glycerol with 4 ml pyrogen free water, were mixed by inversion for no less than 30 minutes.

Anesthesia: Rats were anesthetized with Equithesine 4 ml/kg body weight.

Right external auditory canal (REAC) delivery: A 10 µl sample volume (warm glycerol based eardrops, 37° C.) was slowly instilled into external REAC, using blunt pipette tip. This volume was delivered into each right ear (groups I-IV according study design). During and after REAC instillations, rats were observed and returned to cage after regaining consciousness.

Scheduled euthanasia: Rats from all groups were euthanized according to the study design (Table 2, Time points termination).

Termination step: was accomplished by cardiac puncture and blood collection; collected serum/plasma was stored (20° C.) for further siRNA blood detection analysis (back up).

Tissue Collection: Rats were sacrificed. Left and right temporal bones including cochlea were gently harvested from all animals; and bony cochlea were prepared and proceed for cryosections as described below.

Tissue Embedding Protocol for Cryosections

Perforated bony cochlea: the cochlear apical end of the cochlear capsule was placed in fixative: 4% PFA in PBS pH 7.2-7.4 and incubated at room temperature 1.5 h with rotation on a rotator. The samples were washed 3×5 mill with PBS with rotation. The bony cochlea was decalcified in 10% EDTA/PBS pH 7.2-7.4 overnight or longer at 4° C. with rotation. Decalcification was determined by gently pressing on the bony cochlea with a forceps/syringe needles. If decalcification required more time, the decalcification solution (fresh 10% EDTA in PBS) was changed.

For the infiltration step: stock solutions of 10% and 30% sucrose in PBS were prepared. The tissue was rinsed 2×5 min in PBS, pH 7.2-7.4, followed by washing 30 min in 10% sucrose, at room with rotation on the tissue rotator. The tissue was washed 30 min in a 2:1 solution of 10:30% sucrose at of the room temperature with rotation, followed by a 30 min wash in a 1:1 solution of 10:30% sucrose at room temperature with rotation, then in a 1:2 solution of 10:30% sucrose at room temperature with rotation for 30 min, and finally at 4° C. in 30% sucrose with rotation, overnight.

The cochleae were transferred into tubes with degassed OCT (30 min in desiccator) and the vials maintained at 4° C. overnight with rotation.

The cochleae were placed in the OCT and oriented by aligning an imaginary plane through the modiolus parallel with the bottom of the embedding mold, followed by placement in cryostat for cryosectioning.

Evaluation:

Delivery of siRNA was evaluated using fluorescent microscopy and digital imaging. A tissue fragments (cochlea) will be considered positive (i.e., a successful Cy3 DDIT4_1 siRNA transfer incorporation occurred) only if histological (microscopic) examination showed clear fluorescence signal within specific cochlear structures. Background DAPI staining was assisted in identification of cochlea tissue (anatomical or topographical) structure. Inner ear delivery was considered positive if histological examination showed consistency within the group (i.e. time points, time course etc).

FIG. 1 shows the delivery of Cy3-labelled DDIT4 siRNA into the spiral ganglion (ganglion of Corti) in the apical turn of the organ of Corti following application of ear drops containing Cy3-labelled siRNA formulated in 20% glycerol. Upper panel is X40 magnification of phalloidin-labelled cells (left panel), bright field (BF, right panel) and the merge thereof (middle panel, M). Bottom panel is X60 magnification of phalloidin-labelled cells (left panel), bright field (BF, right panel) and the merge thereof (middle panel, M). Three days after eardrop application (100 ug in 10 ul of 20% glycerol of Cy3-labeled DDIT4 siRNA) the rats were perfused with 4% PFA. Temporal bones were removed and the bony cochleae were dissected. Whole mount Corti were prepared with Alexa488 labelled phalloidin which binds to actin filaments. Delivery of siRNA was evaluated using confocal microscopy and digital imaging. A tissue fragment was considered positive (i.e., a successful Cy3 DDIT4 siRNA transfer intracellular incorporation occurred) only where histological (microscopic) examination showed clear fluorescence signal within specific cells or structures.

Figure 2:
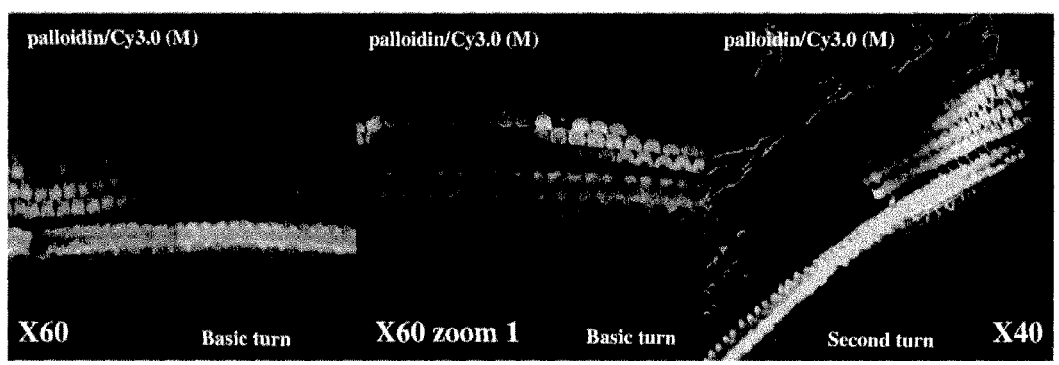
FIG. 2. Shows Cy3 labelled DDIT4 siRNA in three rows of outer hear cells, inner hear cells and supporting cells in all, basic, second and apical turns of organ of Corti.
Figure 2:
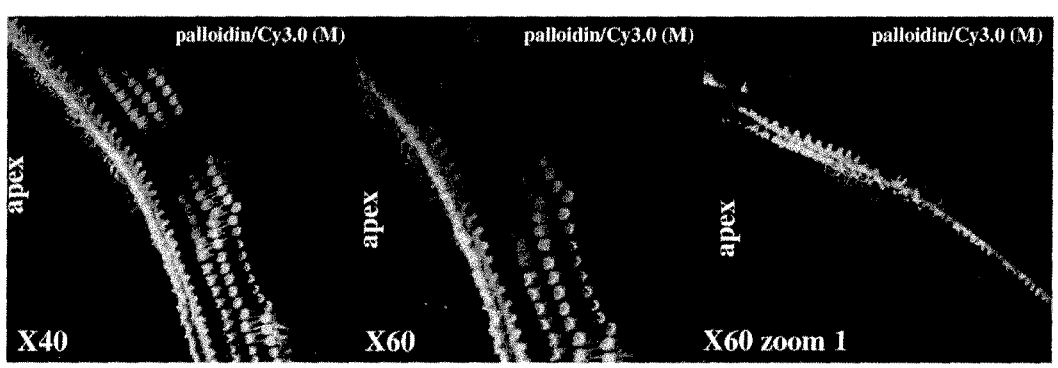

FIG. 2 shows the delivery of Cy3 labelled DDIT4 siRNA in three rows of outer hair cells, inner hair cells and supporting cells in basic, second and apical turns of organ of Corti. The delivery of Cy3 labelled DDIT4 siRNA was determined three days after eardrop application (100 ug in 10 ul of 20% glycerol of Cy3-labeled DDIT4 siRNA).

Figure 3:
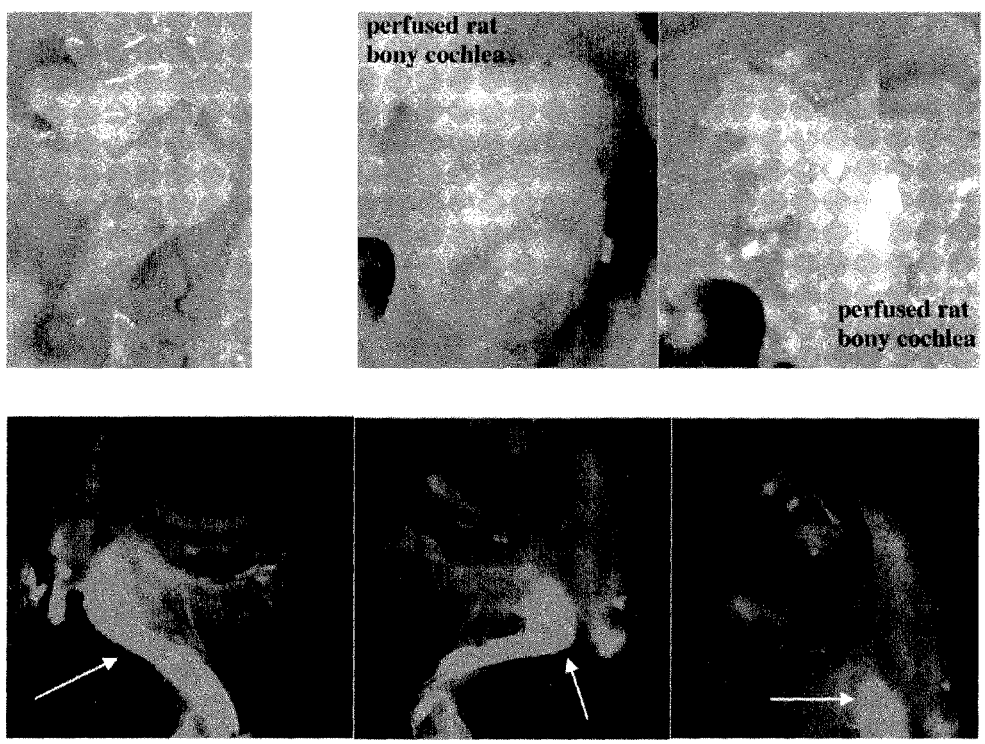
FIG. 3. Shows fluorescence in all parts of the auditory epithelium of dissected rat cochlea 3 days post administration of eardrops (perfused and non perfused).

FIG. 3 shows the delivery of Cy3 labelled DDIT4 siRNA into the rat auditory epithelium. Top panel is dissected rat bony cochlea (perfused with 4% PFA). Bottom panel demonstrates the delivery of Cy3 labelled DDIT4 siRNA into the basic, second and apical turns of the auditory epithelium.

Example 3

Examination of Inner Ear Non-Invasive Delivery of Formulated Cy3-DDIT4_1 siRNA in Rats Description of the test material: double-stranded Cy3-labeled 19-mer DDIT4_1 siRNA, Cy3 is linked to the 3' end of the antisense strand via an extra 'dT' nucleotide. Both sense and anti-sense strands harbor alternating 2'OMe sugar modified ribonucleotides on every odd nucleotide of the antisense strand and on every even nucleotide of the sense strand.

Three different formulations were tested:

Formulation 1: 100 µg of Cy3 DDIT4 siRNA in 10 µl of 30% glycerol.

Formulation 2: 100 µg of Cy3 DDIT4 siRNA in 10 µl of PBS.

Formulation 3: 100 µg of Cy3 DDIT4 siRNA in 10 µl of 20% mineral oil (v/v), 40% Propylene glycol (v/v) and 10% Ethanol (v/v).

Right external auditory canal (REAC) delivery: A 10 µl sample volume (warm formulated eardrops, 37° C.) was slowly instilled into external REAC, using blunt pipette tip. This volume was delivered into the right ear. During and after REAC instillations, rats were kept on contralateral side for 40 minutes and returned to its cage following recovery.

Tissue Collection: Rats were decapitated. Both temporal bones were gently harvested from all animals and postfixed for additional 1 hour in 10% neutral buffered formalin. Thereafter the bony cochlea was dissected, followed by Alexa488-phalloidin immunostaining and whole mount organ of Corti preparation and contra stained with DAPI stain.

Delivery of siRNA was evaluated using fluorescence microscopy and digital imaging. Tissue fragments (organ of Corti) were considered positive (i.e., a successful Cy3 DDIT4_1 siRNA delivery occurred) only if histological (microscopic) examination showed clear fluorescent signal within specific cochlea's structures. Background DAPI staining was used for the identification of cochlea tissue structure. Inner ear delivery was considered positive if histological examination had consistency within all turns of organ of Corti (basal, second and apical).

Results: Positive siRNA delivery into the inner ear cochlear structures was detected following application of 30% glycerol (Formulation 1) or 20% mineral oil (v/v), 40% Propylene glycol (v/v) and 10% Ethanol (v/v) (Formulation 3) using ear drops. All turns of organ of Corti and spiral ganglions were labeled at the amount of 100 µg, however the signal with the mineral oil formulation was weaker than the glycerol formulation.

Example 4

QM5 siRNA Treatment in Ear Drops Induced Knockdown of p53 Protein Expression Levels in the Rat Inner Ear After Cisplatin Administration The objective of this experiment was to evaluate the knockdown of Cisplatin induced p53 protein in the inner ear (Cochlea) of rats that were treated with eardrops contain QM5 siRNA (rat siRNA targeting rat p53).

Experimental group I: was treated once with QM5 siRNA (sense strand: GAAGAAAAUUUCCGCAAAA (SEQ ID NO:5845); antisense strand: UUUUGCGGAAAUUUU-CUUC (SEQ ID NO:5846)); at a dose of 100 µg/30% Glycerol /10 µl, delivered by the eardrops (ErD), route: REAC; QM5 siRNA treatment was performed on day 1, prior to the 1st Cisplatin administration. The contra lateral ear (Left), serves as untreated control. QM5 siRNA is designed as alternating ribonucleotides modified at the 2' position of the sugar residue in both the antisense and the sense strands, wherein the moiety at the 2' position is methoxy (2'OMe sugar modified).

Experimental Group II: Untreated Normal Control Rats

Experiment Design:

| Group No.: | Treatment QM5 siRNA 100 µg/10 µl of 30% glycerol | Delivery route REAC (10 µl) | Cisplatin I.P. dose regime (2 mg/kg) | Termination time point (hrs) | Group size |
|---|---|---|---|---|---|
| I | Day 1 | ErD | X5 | 72 | 19 |
| II | none | none | none | N/A | 12 (6 × 2) |

Measured Variables: Body weight, Serum Creatinine and P53 protein signal by ELISA.

P53 Protein signal

The Cisplatin control group (Sample 2) exhibited an increase of 49% in the level of P53 protein signal compared to the Naïve group (Sample 1). Namely, the rats receiving Cisplatin treatment showed increased p53 levels in cochlea with respect naïve rats. The QM5 siRNA treatment caused a reduction of p53 signal to 2.69, which is only 12% higher compared to the Naïve group.

TABLE 3

QM5 siRNA Treatment in eardrop Induced Knockdown of p53 Protein Expression Levels in the Rat Inner Ear After Cisplatin Administration

| Sample | Sample Description | P53 protein level |
|---|---|---|
| 1 | Naive rat cochlea 346 ug/well | 2.40 |
| 2 | Cisplatin only Left ear 346 ug/well | 3.58 |
| 3 | Cisplatin plus QM5 siRNA Right ear 346 ug/well | 2.69 |

Example 5

Inner Ear Delivery of Fluorescence Labelled siRNA with L-DNA Structure in Rats

Description of the test material: sterile 10 mg/ml Cy3-AS-CASP2_4-Struc-L-DNA (alternating 2-O-methylation in the antisense strand and L-DNA nucleotide in position 18 of the sense strand; Sense: GCCAGAAUGUGGAACUCCU (SEQ ID NO:5847); Antisense: AGGAGUUCCACAUUCUGGC (SEQ ID NO:5848)) or DDIT4_1-Cy3.5 (alternating 2-O-methylation in the sense and antisense strands) in 30% sterile glycerol solution in pyrogen free water. Cy3 is linked to the 3' end of the antisense strand.

General: The study included 4 experimental groups as described in Table 4: Experimental groups I-IV (treated by siRNA (DDIT4_1-Cy3.5 or Cy3-AS-CASP2_4-Struc-L-DNA) glycerol based eardrop). Rats were treated by Ear props (ErD) with a single siRNA dose as follows:

Groups I-IV: dose regime: 100 µg/10 µl/ear of 30% glycerol administration route: REAC (right external auditory canal))/unilateral (Groups I and III) and REAC/LEAC (right/left external auditory canals)/bilateral (Groups II and IV).

TABLE 4

Study Design

| Group | SiRNA Type | Dose µg/rat | Delivery Vol. (µl) | Route | Termination (Days) | Group Size |
|---|---|---|---|---|---|---|
| I | DDIT4_1-Cy3.5 | 100 µg | 10.00 | REAC/Unilateral | 3 | 1 |
| II | DDIT4_1-Cy3.5 | 100 µg | 10.00 | REAC/LEAC/Bilateral | 3 | 1 |
| III | Cy3-AS-CASP2_4-Struc-L-DNA | 100 µg | 10.00 | REAC/Unilateral | 3 | 1 |
| IV | Cy3-AS-CASP2_4-Struc-L-DNA | 100 µg | 10.00 | REAC/LEAC/Bilateral | 3 | 1 |

Right external auditory canal (REAC/unilateral) delivery: A 10 µl sample volume (warm glycerol based eardrops, 37° C.) was slowly instilled into REAC, using blunt pipette tip. This volume was delivered into each right ear (groups I and III according study design). During and after REAC instillations, rats were kept on contra lateral recumbency (left side) for 40 minutes and then returned to its cage after recovery.

Right and Left bilateral external auditory canal (REAC/LEAC/bilateral) delivery: A 10 µl sample volume (warm glycerol based eardrops, 37° C.) was slowly instilled into external REAC, using blunt pipette tip. This volume was delivered into each right ear (groups II and IV according study design). During and after REAC instillations, rats were kept on contra lateral recumbency (left side) for 30 minutes, after that turned to the right side and a 10 µl sample volume (warm glycerol based eardrops, 37° C.) was slowly instilled into LEAC, using blunt pipette tip and were kept for additional 30 minutes and returned to its cage after recovery.

Tissue Collection: Rats were decapitated. Left and right temporal bones including cochlea were collected and post fixed in 4% PFA, whole mount Corti staining was performed.

EVALUATION: Delivery of siRNA was evaluated using light microscopy and digital imaging. Tissue fragments (cochlea) were considered positive (i.e., a successful siRNA delivery) only if histological (microscopic) examination showed clear fluorescence signal within specific cochlea's structures. Background. DAPI staining was used to assist in identifying cochlea tissue structure.

Results: Positive siRNA delivery into the inner ear cochlear structures following application of the siRNA by ear drops was observed with both siRNA molecules (Cy3.5 labelled DDIT4 with alternating structure, and Cy3 labelled Casp2_4 with L-DNA structure). The siRNA which was delivered by unilateral application (right ear) was detected in all turns of organ of Corti and spiral ganglions at the concentration of 100 ug in 10 ul 30% warm glycerol.

Example 6

The Effect of Glycerol Concentration on siRNA Delivery to Rat Inner Ear Tissues Using Ear Drop Formulation as Determined by siRNA Quantitation 6-A: Rats were subjected to unilateral application of eardrops containing 200 µg siRNA/10 µl of PBS, 5%, 10%, 20% or 30% Glycerol. The concentration of siRNA was 10 mg/ml and the siRNA molecule tested was specific to CASP2 mRNA (CASP2_4 siRNA molecule having alternating 2'OMe sugar modified ribonucleotides in the antisense strand and L-DNA nucleotide in position 18 of the sense strand; Sense sequence: GCCAGAAUGUGGAACUCCU (SEQ ID NO:5847); Antisense sequence: AGGAGUUCCACAUUCUGGC (SEQ ID NO:5848)). The cochlear tissue was dissected four hours following eardrops application and the amount of siRNA in the tissue was determined quantitatively using qPCR. Table 5 below summarizes the quantitative results obtained in this experiment.

These results revealed that the delivery of siRNA into the cochlea by eardrops was effective when the eardrop formulation comprises between 5-20% glycerol as a carrier. The delivery of siRNA into the cochlea by eardrops was most effective when the eardrop formulation comprises 10% glycerol as a carrier.

TABLE 5

| Treatment | No of animals | SiRNA quantity (fmol/1 µg RNA) | Std |
|---|---|---|---|
| 200 µg/10 µl PBS | 3 | 29.09 | 21.20 |
| 200 µg/10 µl 5% Glycerol | 2 | 92.17 | 27.72 |
| 200 µg/10 µl 10% Glycerol | 3 | 161.21 | 16.26 |
| 200 µg/10 µl 20% Glycerol | 2 | 93.78 | 6.52 |
| 200 µg/10 µl 30% Glycerol | 3 | 39.21 | 22.83 |

6-B: The above experiment is carried out in the same format with the exception of treating the animals with cisplatin. 10 experimental groups of (6 rats/group each) as follows: Groups are treated with a single siRNA administration: at a dose of 100 mg/10 ml, PBS, 5%5, 10%, 20% 25% or 30% Glycerol delivered by eardrops (ErD), route: REAC; siRNA treatment is performed on day 1 (study initiation), 24 hours prior to the 1st Cisplatin administration (at Cisplatin dose regime: 4 mg/kg daily; administration route: I.P.; injection volume: 1 ml for 250 g rat BW). Rats are subjected to 3 consecutive i.p. injections of Cisplatin (stock concentration: 50 mg/ml; LD50 I.P. dose 6.4 mg/kg). Termination step is performed 24 hrs after the last Cisplatin administration on Day 5 after study initiation. Control Group is treated with a single Vehicle ErD application 10 µl in the same manner as test groups. One experimental group is untreated intact control. The scheduled euthanasia is performed according to the study design. SiRNA to target genes TP53BP2 (ASPP2), BNIP3, CASP2, NOX3, HRK, RAC1, DDIT4, DDIT4L, NOX4, HTRA2, CAPNS1 (Calpain), ID3, HES1, HES5, CDKN1B and ID3.

Example 7

Chinchilla Models of Hearing Loss (i) Chinchilla Model of Carboplatin-Induced or Cisplatin-Induced Cochlea Hair Cell Death Chinchillas are pre-treated by direct administration of specific siRNA in 5%, 10%, 12.5%, 15%, 20%, 25% or 30% glycerol or other permeability enhancer to the left ear of each animal. Glycerol or other vehicle/agent (same final concentrations) is administered to the right ear of each animal as placebo. Two days following the administration of the specific siRNA compounds of the invention, the animals are treated with carboplatin (75 mg/kg i.p.) or cisplatin (intraperitoneal infusion of 13 mg/kg over 30 minutes). After sacrifice of the chinchillas (two weeks post carboplatin treatment) the % of dead cells of inner hair cells (IHC) and outer hair cells (OHC) is calculated in the left ear (siRNA treated) and in the right ear (saline treated). It is calculated that the percent of dead cells of inner hair cells (IHC) and outer hair cells (OHC) is lower in the left ear (siRNA treated) than in the right ear (vehicle control).

(ii) Chinchilla Model of Acoustic-Induced Cochlea Hair Cell Death

The activity of specific siRNA in an acoustic trauma model is studied in chinchilla. The animals are exposed to an octave band of noise centered at 4 kHz for 2.5 h at 105 dB. The left ear of the noise-exposed chinchillas is pre-treated (48 h before the acoustic trauma) with 30 µg of siRNA in ~10 µL of glycerol; the right ear is pre-treated with vehicle (10% glycerol). The compound action potential (CAP) is a convenient and reliable electrophysiological method for measuring the neural activity transmitted from the cochlea. The CAP is recorded by placing an electrode near the base of the cochlea in order to detect the local field potential that is generated when a sound stimulus, such as click or tone burst, is abruptly turned on. The functional status of each ear is assessed 2.5 weeks after the acoustic trauma. Specifically, the mean threshold of the compound action potential recorded from the round window is determined 2.5 weeks after the acoustic trauma in order to determine if the thresholds in the siRNA-treated ear are lower (better) than the untreated (vehicle control) ear. In addition, the amount of inner and outer hair cell loss is determined in the siRNA-treated and the control ear.

SEQUENCE LISTING (5848 sequences)

SEQ ID NO: 1 - RNA, 3405 nt, Homo_sapiens
augcgguucggguccaagaugaugccgauguuucuuaccguguaucucaguaacaaugagcagcacuucacagaaguuccaguuacuccagaaacaauaugcagagacgugguggaucugugcaaagaacccggcgagagugauugccauuuggcugaagugugguguggcucugaacguccaguugcggauaaugagcgaauguuugauguucuucaacgauuuggaagucagaggaacgaaguucgcuucuuccuucgucaugaacgccccccuggcagggacauugugaguggaccaagaucucaggauccaaguuuaaaaagaaaugguguaaaaguuccuggugaauaucgaagaaaggagaacgguguuaauaguccuaggauggaucugacucuugcugaacuucaggaaauggcaucucgccagcagcaacagauugaagcccagcaacaauugcuggcaacuaaggaacagcgcuuaaaguuuuugaaacaacaagaucagcgacaacagcaacaaguugcugagcaggagaaacuuaaaaggcuaaaagaaauagcugagaaucaggaagcuaagcuaaaaaaagugagagcacuuaaaggccacguggaacagaagagacuaagcaaugggaaacuuguggaggaaauugaacagaugaauaauuuguuccagcaaaaacagagggagcucguccuggcugugucaaaaguagaagaacugaccaggcagcuagagaugcucaagaacggcaggaucgacagccaccaugacaaucagucugcaguggcugagcuugaucgccucuauaaggagcugcagcuaagaaacaaauugaaucaagagcagaaugccaagcuacaacaacagagggaguguuugaauaagcguaauucagaaguggcagucauggauaagcguguuaaugagcugagggaccggcuguggaagaagaaggcagcucuacagcaaaaagaaaaucuaccaguuucaucugauggaaaucuuccccagcaagccgcgucagccccaagccguguggcugcaguaggucccuauauccagucgucuacuaugccucggaugcccucaaggccugaauugcuggugaagccagcccugccggaugguuccuuggucauucaggcuucagaggggccgaugaaaauacagacacugcccaacaugagaucuggggcugcuucacaaacuaaaggcucuaaaauccauccaguuggcccugauuggaguccuucaaaugcagaucuuuucccaagccaaggcucugcuucuguaccucaaagcacugggaaugcucuggaucaaguugaugauggagagguuccgcugagggagaaagagaagaaagugcguccguucucaauguuugaugcaguagaccaguccaaugccccaccuuccuuugguacucugaggaagaaccagagcagugaagauaucuugcgggaugcucagguugcaaauaaaaauguggcuaaaguaccaccuccuguuccuacaaaaccaaaacagauuaauuugccuuauuuuggacaaacuaaucagccaccuucagacauuaagccagacggaaguucucagcaguugucaacaguuguuccguccaugggaacuaaaccaaaaccagcagggcagcagccgagagugcugcuaucucccagcauaccuucgguuggccaagaccagacccuuucuccagguucuaagcaagaaaguccaccugcugcugccguccggcccuuuacuccccagccuuccaaagacaccuuacuuccacccuucagaaaaccccagaccguggcagcaaguucaauauauuccauguauacgcaacagcaggcgccaggaaaaaacuuccagcaggcugugcagagcgcguugaccaagacucauaccagagggccacacuuuucaaguguauaugguaagccuguaauugcugcugcccagaaucaacagcagcacccagagaacauuuauuccaauagccagggcaagccuggcaguccagaaccugaaacagagccuguuucuucaguucaggagaaccaugaaaacgaaagaauuccucggccacucagcccaacuaaauuacugccuuucuuaucuaauccuuaccgaaaccagagugaugcugaccuagaagccuuacgaaagaaacugucuaacgcaccaaggccucuaaagaaacguaguucuauuacagagccagaggguccuaaugggccaaauauucagaagcuuuuauaucagaggaccaccauagcggccauggagaccaucucugucccaucauacccauccaagucagcuucugugacugccagcucagaaagcccaguagaaauccagaauccauauuuacauguggagcccgaaaaggagguggucucucugguuccugaaucauuguccccagaggauguggggaaugccaguacagagaacagugacaugccagcuccuucuccaggccuugauuaugagccugagggagucccagacaacagcccaaaucuccagaauaacccagaagaaccaaauccagaggcuccacaugugcuugauguguaccuggaggaguacccuccauacccacccccaccauacccaucuggggagccugaagggcccggagaagacucggugagcaugcgcccgccugaaaucaccgggcaggucucucugccuccugguaaaaggacaaacuugcguaaaacuggcucagagcguaucgcucauggaaugagggugaaauucaacccccuugcuuuacugcuagauucgucuuuggagggagaauuugaccuuguacagagaauuauuuaugagguugaugacccaagccuccccaaugaugaaggcaucacggcucuucacaaugcugugugugcaggccacacagaaaucguuaaguuccugguacaguuugguguaaauguaaaugcugcugauagugauggauggacuccauuacauugugcugccucauguaacaacguccaaguguguaaguuuuugguggagucaggagccgcuguguuugccaugaccuacagugacaugcagacugcugcagauaagugcgaggaaauggaggaaggcuacacucagugcucccaauuucuuuauggaguucaggagaagaugggcauaaugaauaaaggagucauuuaugcgcuuugggauuaugaaccucagaaugaugaugagcugcccaugaaagaaggagacugcaugacaaucauccacagggaagacgaagaugaaaucgaaugguggugggcgcgccuuaaugauaaggagggauauguuccacguaacuugcugggacuguacccaagaauuaaaccaagacaaaggagcuuggccuga

SEQ ID NO: 2 - RNA, 4802 nt, Homo_sapiens
gcuggggcccgacccgggauuaguugguuucggagcggaggagggagccccgaccgucacgagcgucgaagagacaaagccgcgucagggggcccggccggggcgggggagcccggggcuuguuggugccccagcccgcgcggagggcccuucggacccgcgcgccgccgcugccgccgccgccgccucgcaacagguccgggcggccucgcucuccgcuccccucccccgcauccgcgacccuccggggcaccucagcucggccggggccgcagucuggccacccgcuuccaugcgguucggguccaagaugaugccgauguuucuuaccguguaucucaguaacaaugagcagcacuucacagaaguuccaguuacuccagaaacaauaugcagagacgugguggaucugugcaaagaacccggcgagagugauugccauuuggcugaagugugguguggcucuguagagauagaguuucaucauguuggccaggauggucucgaucuccugaccuugugauccgccugccucggccucccaaagugcuggauuacaggugugagccaccacgaucagccucuaguguuuaaaaaagaacguccaguugcggauaaugagcgaauguuugauguucuucaacgauuuggaagucagaggaacgaaguucgcuucuuccuucgucaugaacgccccccuggcagggacauugugaguggaccaagaucucaggauccaaguuuaaaaagaaaugguguaaaaguuccuggugaauaucgaagaaaggagaacgguguuaauaguccuaggauggaucugacucuugcugaacuucaggaaauggcaucucgccagcagcaacagauugaagcccagcaacaauugcuggcaacuaaggaacagcgcuuaaaguuuuugaaacaacaagaucagcgacaacagcaacaaguugcugagcaggagaaacuuaaaaggcuaaaagaaauagcugagaaucaggaagcuaagcuaaaaaaagugagagcacuuaaaggccacguggaacagaagagacuaagcaaugggaaacuuguggaggaaauugaacagaugaauaauuuguuccagcaaaaacagagggagcucguccuggcugugucaaaaguagaagaacugaccaggcagcuagagaugcucaagaacggcaggaucgacagccaccaugacaaucagucugcaguggcugagcuugaucgccucuauaaggagcugcagcuaagaaacaaauugaaucaagagcagaaugccaagcuacaacaacagagggaguguuugaauaagcguaauucagaaguggcagucauggauaagcguguuaaugagcugagggaccggcuguggaagaagaaggcagcucuacagcaaaaagaaaaucuaccaguuucaucugauggaaaucuuccccagcaagccgcgucagccccaagccguguggcugcaguaggucccuauauccagucgucuacuaugccucggaugcccucaaggccugaauugcuggugaagccagcccugccggaugguuccuuggucauucaggcuucagaggggccgaugaaaauacagacacugcccaacaugagaucuggggcugcuucacaaacuaaaggcucuaaaauccauccaguuggcccugauuggaguccuucaaaugcagaucuuuucccaagccaaggcucugcuucuguaccucaaagcacugggaaugcucuggaucaaguugaugauggagagguuccgcugagggagaaagagaagaaagugcguccguucucaauguuugaugcaguagaccaguccaaugccccaccuuccuuugguacucugaggaagaaccagagcagugaagauaucuugcgggaugcucagguugcaaauaaaaauguggcuaaaguaccaccuccuguuccuacaaaaccaaaacagauuaauuugccuuauuuuggacaaacuaaucagccaccuucagacauuaagccagacggaaguucucagcaguugucaacaguuguuccguccaugggaacuaaaccaaaaccagcagggcagcagccgagagugcugcuaucucccagcauaccuucgguuggccaagaccagacccuuucuccagguucuaagcaagaaaguccaccugcugcugccguccggcccuuuacuccccagccuuccaaagacaccuuacuuccacccuucagaaaaccccagaccguggcagcaaguucaauauauuccauguauacgcaacagcaggcgccaggaaaaaacuuccagcaggcugugcagagcgcguugaccaagacucauaccagagggccacacuuuucaaguguauaugguaagccuguaauugcugcugcccagaaucaacagcagcacccagagaacauuuauuccaauagccagggcaagccuggcaguccagaaccugaaacagagccuguuucuucaguucaggagaaccaugaaaacgaaagaauuccucggccacucagcccaacuaaauuacugccuuucuuaucuaauccuuaccgaaaccagagugaugcugaccuagaagccuuacgaaagaaacugucuaacgcaccaaggccucuaaagaaacguaguucuauuacagagccagaggguccuaaugggccaaauauucagaagcuuuuauaucagaggaccaccauagcggccauggagaccaucucugucccaucauacccauccaagucagcuucugugacugccagcucagaaagcccaguagaaauccagaauccauauuuacauguggagcccgaaaaggagguggucucucugguuccugaaucauuguccccagaggauguggggaaugccaguacagagaacagugacaugccagcuccuucuccaggccuugauuaugagccugagggagucccagacaacagcccaaaucuccagaauaacccagaagaaccaaauccagaggcuccacaugugcuugauguguaccuggaggaguacccuccauacccacccccaccauacccaucuggggagccugaagggcccggagaagacucggugagcaugcgcccgccugaaaucaccgggcaggucucucugccuccugguaaaaggacaaacuugcguaaaacuggcucagagcguaucgcucauggaaugagggugaaauucaacccccuugcuuuacugcuagauucgucuuuggagggagaauuugaccuuguacagagaauuauuuaugagguugaugacccaagccuccccaaugaugaaggcaucacggcucuucacaaugcugugugugcaggccacacagaaaucguuaaguuccugguacaguuugguguaaauguaaaugcugcugauagugauggauggacuccauuacauugugcugccucauguaacaacguccaaguguguaaguuuuugguggagucaggagccgcuguguuugccaugaccuacagugacaugcagacugcugcagauaagugcgaggaaauggaggaaggcuacacucagugcucccaauuucuuuauggaguucaggagaagaugggcauaaugaauaaaggagucauuuaugcgcuuugggauuaugaaccucagaaugaugaugagcugcccaugaaagaaggagacugcaugacaaucauccacagggaagacgaagaugaaaucgaaugguggugggcgcgccuuaaugauaaggagggauauguuccacguaacuugcugggacuguacccaagaauuaaaccaagacaaaggagcuuggccugaaacuuccacacagaauuuuagucaaugaagaauuaaucucuguuaagaagaaguaauacgauuauuuuuggcaaaaauuucacaagacuuauuuuaaugacaauguagcuugaaagcgaugaagaaugucucuagaagagaaugaaggauugaagaauucaccauuagaggacauuuagcgugaugaaauaaagcaucuacgucagcaggccauacuguguuggggcaaaggugucccguguagcacucagauaaguauacagcgacaauccuguuuucuacaagaauccugucuaguaaauaggaucauuuauugggcaguugggaaaucagcucucuguccuguugaguguuuucagcagcugcuccuaaaccaguccuccugccagaaaggaccagugccgucacaucgcugucucugauuguccccggcaccagcaggcccuuggggggcucaccugaaggcucgaaggcacugcacacuuguauauugucagugaagaacuguuaguugguugucagugaacaauaacuuuauuauaugaguuuuuguagcaucuuaagaauuauacauauguuugaaauauugaaacuaagcuacgguaccaguaauuagauguagaaucuuguuuguaggcugaauuuuaaucuguauuuauugucuuuuguaucucagaaauuagaaacuugcuacagacuuacccguaauauuugucaagaucauagcugacuuuaaaaacaguuguaauaaacuuuuugaugcuagcuguuuacugguuuuuguuuuugaugucauaaauagaccuuguuuaauagucacaagccguugggauaucauacccagcugaaaaagaacaaacugcuuaacauaaguauauguaucguaauaagaguuuuuuaccagcuaagugauucaauguaagugguuuuuaaaauaaaauacuguagagaucauggugaaaaaaaaaaaaaa

SEQ ID NO: 3 - RNA, 3046 nt, Homo_sapiens
gccggcgggaucccaggcgccgagcgcccgcugagcagccacccuuugcgcgccgccugcagcgcagcuuccccgggcgcugccuggacaggccugccugcgugcugggacaugucuggccuccaaggaccgucggugggcgauggcugcaacgguggaggggccagagcuggaggcagcugcugccgcaggagaugcuucagaggauucggacgcaggguccagggcgcugccuuuccugggcggcaaccggcugagcuuggaccuguaccccgggggcugccagcagcugcugcaccuguguguccagcagccucugcagcugcugcagguggaauucuugcgucugagcacucacgaggacccucagcugcuggaggccacccuggcccagcugccucagagccuguccugccuccgcucccugguccucaaagggucgaucugggaccucggacccuggcucugagggccacauccgccuccccccuucccaggagggcaacgccgggacacacugggugccugucuccggggugcccugaccaaccugcccgcuggucugaguggccuggcccaucuggcccaccuggaccugagcuucaacagccuggagacacugccggccuguguccugcagaugcgaggucugggugcgcucuugcugucucacaacugccucucugagcugccugaggcucugggggcccuccccgcccucaccuuccucacagugacacacaaccgccugcagacgcugcccccagcacugggggcccuauccacccugcagcgccucgaucucucucagaaucugcuggacacgcuaccuccugagauuggaggccugggcagccuccuggagcucaaccuggccuccaaccggcugcagagccucccagccucucuggcgggacuucgguccuugcggcuccuuguccugcacagcaaccuccuggccucugugccagcugacuuggcccgccuuccacuccucacccggcucgaccugagggacaaccagcuccgggaccugcccccugagcugcuagacgcccccuuugugcgccugcaggggaacccccugggugaggccucgccagacgccccgaguucaccaguggcagcccucauuccagaaaugcccagacuguuccugaccucagauuuggacagcuuuccugugaccccucaaggcugcucagugacccuggccuguggcguccgccugcaguucccagcgggagccaccgccacccccaucaccauccgcuaucggcugcugcugccggagccaggccucgucccccuggguccucaugacgcccugcucagccaugugcuggagcugcagccccaugggguggccuuccagcaggauguggggcuguggcugcucuucaccccaccgcaggcccggcgcugccgugaagugguggucaggacccggaaugacaacagcuggggugaccuggagaccuaccuggaggaagaggcaccccagcggcucugggcucacugccaggugccccacuucuccugguuccuugugguuucccgcccuguguccaaugccugccuggugccaccggaggggacacugcugugcuccucgggucauccuggggucaaagucaucuuccccccuggggccacugaggagccucgucgagucuccaugcagguggugcgcauggcuggccgagagcugcaggcccuccugggagaaccagaggcugcagugagcccccugcugugccugucacagagcgguccccccagcuuccuccaaccggucaccgugcagcugccucugcccucuggcaucacaggccucagucuggaccgcucccgccugcaccuguuguacugggccccuccugcagccaccugggaugacaucacagcucaggugguccuggagcucacccaccuguacuggcucugguacaccaccaagaacugugugggaggccuggcucggaaggccugggagcggcugcggcugcaccgugugaaccucaucgcucugcagcggcgccgggacccugagcagguccugcugcagugccugccccgaaacaagguggacgccacccuucggcggcugcuggagcgguaccggggccccgagcccucugacacgguggagauguucgagggcgaagaguucuuugcggccuucgagcgcggcaucgacguggaugcugaccgcccugacuguguggagggcagaaucugcuuugucuucuacucgcaccugaagaaugugaaggagguauacgugaccaccacucuggaccgggaggcucaggcugugcggggccagguguccuucuaccguggcgcggugccugugcgggugcccgaggaggcugaggcugcccggcagaggaagggcgcagacgcccuguggauggccacucugcccaucaagcugccgagacuucgaggguccgaggggccacggcggggggcuggccucuccuuggcacccuugaaucugggagaugccgagaccggcuuucugacgcagagcaaccugcugaguguggcugggcgucugggucuggacuggccagccguggcccugcaccuggggguguccuaccgggaggugcagcgcauccggcacgaguuccgggaugaucuggaugagcagauccgucacaugcucuucuccugggcugagcgccaggcugggcagccaggggcuguggggcuccuggugcaggcccuggagcagagugaccggcaggacguggcugaagaggugcgcgcagucuuggagcucggccgccgcaaguaccaggacagcauccgacgcaugggcuuggcccccaaggaccccgcucugccuggcuccucggcuccacagcccccagagccugcccaggccuaggccccacagacuuuuaggcuggcccagauauuccccaguggaugggcagagcccccaccuucaagucucuccaguguguggggacgggucccugugagcaacaaaacugcacuguuucuuucaccucaaaaaaaaaaaaaaaaa

SEQ ID NO: 4 - RNA, 3025 nt, Homo_sapiens
gccggcgggaucccaggcgccgagcgcccgcugagcagccacccuuugcgcgccgccugcagcgcagcuuccccgggcgcugccuggacaggccugccugcgugcugggacaugucuggccuccaaggaccgucggugggcgauggcugcaacgguggaggggccagagcuggaggcagcugcugccgcaggagaugcuucagaggauucggacgcaggguccagggcgcugccuuuccugggcggcaaccggcugagcuuggaccuguaccccgggggcugccagcagcugcugcaccuguguguccagcagccucugcagcugcugcagguggaauucuugcgucugagcacucacgaggacccucagcugcuggaggccacccuggcccagcugccucagagccuguccugccuccgcucccugguccucaaaggagggcaacgccgggacacacugggugccugucuccggggugcccugaccaaccugcccgcuggucugaguggccuggcccaucuggcccaccuggaccugagcuucaacagccuggagacacugccggccuguguccugcagaugcgaggucugggugcgcucuugcugucucacaacugccucucugagcugccugaggcucugggggcccuccccgcccucaccuuccucacagugacacacaaccgccugcagacgcugcccccagcacugggggcccuauccacccugcagcgccucgaucucucucagaaucugcuggacacgcuaccuccugagauuggaggccugggcagccuccuggagcucaaccuggccuccaaccggcugcagagccucccagccucucuggcgggacuucgguccuugcggcuccuuguccugcacagcaaccuccuggccucugugccagcugacuuggcccgccuuccacuccucacccggcucgaccugagggacaaccagcuccgggaccugcccccugagcugcuagacgcccccuuugugcgccugcaggggaacccccugggugaggccucgccagacgccccgaguucaccaguggcagcccucauuccagaaaugcccagacuguuccugaccucagauuuggacagcuuuccugugaccccucaaggcugcucagugacccuggccuguggcguccgccugcaguucccagcgggagccaccgccacccccaucaccauccgcuaucggcugcugcugccggagccaggccucgucccccuggguccucaugacgcccugcucagccaugugcuggagcugcagccccaugggguggccuuccagcaggauguggggcuguggcugcucuucaccccaccgcaggcccggcgcugccgugaagugguggucaggacccggaaugacaacagcuggggugaccuggagaccuaccuggaggaagaggcaccccagcggcucugggcucacugccaggugccccacuucuccugguuccuugugguuucccgcccuguguccaaugccugccuggugccaccggaggggacacugcugugcuccucgggucauccuggggucaaagucaucuuccccccuggggccacugaggagccucgucgagucuccaugcagguggugcgcauggcuggccgagagcugcaggcccuccugggagaaccagaggcugcagugagcccccugcugugccugucacagagcgguccccccagcuuccuccaaccggucaccgugcagcugccucugcccucuggcaucacaggccucagucuggaccgcucccgccugcaccuguuguacugggccccuccugcagccaccugggaugacaucacagcucaggugguccuggagcucacccaccuguacgcacgcuuccaggucacacacuucuccugguacuggcucugguacaccaccaagaacugugugggaggccuggcucggaaggccugggagcggcugcggcugcaccgugugaaccucaucgcucugcagcggcgccgggacccugagcagguccugcugcagugccugccccgaaacaagguggacgccacccuucggcggcugcuggagcgguaccggggccccgagcccucugacacgguggagauguucgagggcgaagaguucuuugcggccuucgagcgcggcaucgacguggaugcugaccgcccugacuguguggagggcagaaucugcuuugucuucuacucgcaccugaagaaugugaaggagguauacgugaccaccacucuggaccgggaggcucaggcugugcggggccagguguccuucuaccguggcgcggugccugugcgggugcccgaggaggcugaggcugcccggcagaggaagggcgcagacgcccuguggauggccacucugcccaucaagcugccgagacuucgaggguccgaggggccacggcggggggcuggccucuccuuggcacccuugaaucugggagaugccgagaccggcuuucugacgcagagcaaccugcugaguguggcugggcgucugggucuggacuggccagccguggcccugcaccuggggguguccuaccgggaggugcagcgcauccggcacgaguuccgggaugaucuggaugagcagauccgucacaugcucuucuccugggcugagcgccaggcugggcagccaggggcuguggggcuccuggugcaggcccuggagcagagugaccggcaggacguggcugaagaggugcgcgcagucuuggagcucggccgccgcaaguaccaggacagcauccgacgcaugggcuuggcccccaaggaccccgcucugccuggcuccucggcuccacagcccccagagccugcccaggccuaggccccacagacuuuuaggcuggcccagauauuccccaguggaugggcagagcccccaccuucaagucucuccaguguguggggacgggucccugugagcaacaaaacugcacuguuucuuucaccucaaaaaaaaaaaaaaaaaaaaaaa

SEQ ID NO: 5 - RNA, 2902 nt, Homo_sapiens
gcuuccccgggcgcugccuggacaggccugccugcgugcugggacaugucuggccuccaaggaccgucggugggcgauggcugcaacgguggaggggccagagcuggaggcagcugcugccgcaggagaugcuucagaggauucggacgcaggguccagggcgcugccuuuccugggcggcaaccggcugagcuuggaccuguaccccgggggcugccagcagcugcugcaccuguguguccagcagccucugcagcugcugcagguggaauucuugcgucugagcacucacgaggacccucagcugcuggaggccacccuggcccagcugccucagagccuguccugccuccgcucccugguccucaaaggagggcaacgccgggacacacugggugccugucuccggggugcccugaccaaccugcccgcuggucugaguggccuggcccaucuggcccaccuggaccugagcuucaacagccuggagacacugccggccuguguccugcagaugcgaggucugggugcgcucuugcugucucacaacugccucucugagcugccugaggcucugggggcccuccccgcccucaccuuccucacagugacacacaaccgccugcagacgcugcccccagcacugggggcccuauccacccugcagcgccucgaucucucucagaaucugcuggacacgcuaccuccugagauuggaggccugggcagccuccuggagcucaaccuggccuccaaccggcugcagagccucccagccucucuggcgggacuucgguccuugcggcuccuuguccugcacagcaaccuccuggccucugugccagcugacuuggcccgccuuccacuccucacccggcucgaccugagggacaaccagcuccgggaccugcccccugagcugcuagacgcccccuuugugcgccugcaggggaacccccugggugaggccucgccagacgccccgaguucaccaguggcagcccucauuccagaaaugcccagacuguuccugaccucagauuuggacagcuuuccugugaccccucaaggcugcucagugacccuggccuguggcguccgccugcaguucccagcgggagccaccgccacccccaucaccauccgcuaucggcugcugcugccggagccaggccucgucccccuggguccucaugacgcccugcucagccaugugcuggagcugcagccccaugggguggccuuccagcaggauguggggcuguggcugcucuucaccccaccgcaggcccggcgcugccgugaagugguggucaggacccggaaugacaacagcuggggugaccuggagaccuaccuggaggaagaggcaccccagcggcucugggcucacugccaggugccccacuucuccugguuccuugugguuucccgcccuguguccaaugccugccuggugccaccggaggggacacugcugugcuccucgggucauccuggggucaaagucaucuuccccccuggggccacugaggagccucgucgagucuccaugcagguggugcgcauggcuggccgagagcugcaggcccuccugggagaaccagaggcugcagugagcccccugcugugccugucacagagcgguccccccagcuuccuccaaccggucaccgugcagcugccucugcccucuggcaucacaggccucagucuggaccgcucccgccugcaccuguuguacugggccccuccugcagccaccugggaugacaucacagcucaggugguccuggagcucacccaccuguacgcacgcuuccaggucacacacuucuccugguacuggcucugguacaccaccaagaacugugugggaggccuggcucggaaggccugggagcggcugcggcugcaccgugugaaccucaucgcucugcagcggcgccgggacccugagcagguccugcugcagugccugccccgaaacaagguggacgccacccuucggcggcugcuggagcgguaccggggccccgagcccucugacacgguggagauguucgagggcgaagaguucuuugcggccuucgagcgcggcaucgacguggaugcugaccgcccugacuguguggagggcagaaucugcuuugucuucuacucgcaccugaagaaugugaaggagguguccuucuaccguggcgcggugccugugcgggugcccgaggaggcugaggcugcccggcagaggaagggcgcagacgcccuguggauggccacucugcccaucaagcugccgagacuucgaggguccgaggggccacggcggggggcuggccucuccuuggcacccuugaaucugggagaugccgagaccggcuuucugacgcagagcaaccugcugaguguggcugggcgucugggucuggacuggccagccguggcccugcaccuggggguguccuaccgggaggugcagcgcauccggcacgaguuccgggaugaucuggaugagcagauccgucacaugcucuucuccugggcugagcgccaggcugggcagccaggggcuguggggcuccuggugcaggcccuggagcagagugaccggcaggacguggcugaagaggugcgcgcagucuuggagcucggccgccgcaaguaccaggacagcauccgacgcaugggcuuggcccccaaggaccccgcucugccuggcuccucggcuccacagcccccagagccugcccaggccuaggccccacagacuuuuaggcuggcccagauauuccccaguggaugggcagagcccccaccuucaagucucuccaguguguggggacgggucccugugagcaacaaaacugcacuguuucuuucaccucaaaaaaaaaaaaaaaaa

SEQ ID NO: 6 - RNA, 743 nt, Homo_sapiens
cgcgccuagcagugucccagccggguucgugucgccauggggcagaucgagugggccaugugggccaacgaacaggcgcuggcguccggccugauccucaucaccgggggcaucguggccacagcugggcgcuucacccagugguacuuuggugccuacuccauuguggcgggcguguuugugugccugcuggaguacccccgggggaagaggaagaagggcuccaccauggagcgcuggggacagaaguacaugaccgccguggugaagcuguucgggcccuuuaccaggaauuacuauguucgggccguccugcaucuccugcucucggugcccgccggcuuccugcuggccaccauccuugggaccgccugccuggccauugcgagcggcaucuaccuacuggcggcugugcguggcgagcaguggacgcccaucgagcccaagccccgggagcggccgcagaucggaggcaccaucaagcagccgcccagcaaccccccgccgcggcccccggccgaggcccgcaagaagcccagcgaggaggaggcugcgguggcggcggggggacccccgggagguccccaggucaaccccaucccggugaccgacgaggucgugugaccucgccccggaccugcccucccgccaggugcacccaccugcaauaaaugcagcgaagccgggaaaaaaaaaaaaaaaaaaaaaaaaaaaaaaaaaaaaaaaaaaaaaaaaaaaaaaaa

SEQ ID NO: 7 - RNA, 2629 nt, Homo_sapiens
acuugucauggcgacuguccagcuuugugccaggagccucgcagggguugaugggauugggguuuuccccucccaugugcucaagacuggcgcuaaaaguuuugagcuucucaaaagucuagagccaccguccagggagcagguagcugcugggcuccggggacacuuugcguucgggcugggagcgugcuuuccacgacggugacacgcuucccuggauuggcagccagacugccuuccgggucacugccauggaggagccgcagucagauccuagcgucgagcccccucugagucaggaaacauuuucagaccuauggaaacuacuuccugaaaacaacguucugucccccuugccgucccaagcaauggaugauuugaugcuguccccggacgauauugaacaaugguucacugaagacccagguccagaugaagcucccagaaugccagaggcugcuccccgcguggccccugcaccagcagcuccuacaccggcggccccugcaccagcccccuccuggccccugucaucuucugucccuucccagaaaaccuaccagggcagcuacgguuuccgucugggcuucuugcauucugggacagccaagucugugacuugcacguacuccccugcccucaacaagauguuuugccaacuggccaagaccugcccugugcagcuguggguugauuccacacccccgcccggcacccgcguccgcgccauggccaucuacaagcagucacagcacaugacggagguugugaggcgcugcccccaccaugagcgcugcucagauagcgauggucuggccccuccucagcaucuuauccgaguggaaggaaauuugcguguggaguauuuggaugacagaaacacuuuucgacauagugugguggugcccuaugagccgccugagguuggcucugacuguaccaccauccacuacaacuacauguguaacaguuccugcaugggcggcaugaaccggaggcccauccucaccaucaucacacuggaagacuccagugguaaucuacugggacggaacagcuuugaggugcguguuugugccuguccugggagagaccggcgcacagaggaagagaaucuccgcaagaaaggggagccucaccacgagcugcccccagggagcacuaagcgagcacugcccaacaacaccagcuccucuccccagccaaagaagaaaccacuggauggagaauauuucacccuucagauccgugggcgugagcgcuucgagauguuccgagagcugaaugaggccuuggaacucaaggaugcccaggcugggaaggagccaggggggagcagggcucacuccagccaccugaaguccaaaaagggucagucuaccucccgccauaaaaaacucauguucaagacagaagggccugacucagacugacauucuccacuucuuguuccccacugacagccucccacccccaucucucccuccccugccauuuuggguuuugggucuuugaacccuugcuugcaauaggugugcgucagaagcacccaggacuuccauuugcuuugucccggggcuccacugaacaaguuggccugcacugguguuuuguuguggggaggaggauggggaguaggacauaccagcuuagauuuuaagguuuuuacugugagggauguuugggagauguaagaaauguucuugcaguuaaggguuaguuuacaaucagccacauucuagguagguaggggcccacuucaccguacuaaccagggaagcugucccucauguugaauuuucucuaacuucaaggcccauaucugugaaaugcuggcauuugcaccuaccucacagagugcauugugaggguuaaugaaauaauguacaucuggccuugaaaccaccuuuuauuacauggggucuaaaacuugacccccuugagggugccuguucccucucccucucccuguuggcugguggguugguaguuucuacaguugggcagcugguuagguagagggaguugucaagucuugcuggcccagccaaacccugucugacaaccucuuggucgaccuuaguaccuaaaaggaaaucucaccccaucccacacccuggaggauuucaucucuuguauaugaugaucuggauccaccaagacuuguuuuaugcucagggucaauuucuuuuuucuuuuuuuuuuuuuuuuuucuuuuucuuugagacugggucucgcuuuguugcccaggcuggaguggaguggcgugaucuuggcuuacugcagccuuugccuccccggcucgagcaguccugccucagccuccggaguagcugggaccacagguucaugccaccauggccagccaacuuuugcauguuuuguagagauggggucucacaguguugcccaggcuggucucaaacuccugggcucaggcgauccaccugucucagccucccagagugcugggauuacaauugugagccaccacguggagcuggaagggucaacaucuuuuacauucugcaagcacaucugcauuuucaccccacccuuccccuccuucucccuuuuuauaucccauuuuuauaucgaucucuuauuuuacaauaaaacuuugcugcca

SEQ ID NO: 8 - RNA, 4145 nt, Homo_sapiens
ggguggccuggugugugggcgcggcagggcgcaggcgcaggcgcagugugcguccgcgucugaggggagggaugugggggaagcgacggcccccgguuuguuugggcugugggcggugcgcagcggagagcccgggaaaagcgggaaauggcggcgccgagcgcggggucuugguccaccuuccagcacaaggagcugauggccgcugacaggggacgcaggauauugggaguguguggcaugcauccucaucaucaggaaacucuaaaaaagaaccgaguggugcuagccaaacagcuguuguugagcgaauuguuagaacaucuucuggagaaggacaucaucaccuuggaaaugagggagcucauccaggccaaagugggcaguuucagccagaauguggaacuccucaacuugcugccuaagagggguccccaagcuuuugaugccuucugugaagcacugagggagaccaagcaaggccaccuggaggauauguugcucaccacccuuucugggcuucagcauguacucccaccguugagcugugacuacgacuugagucucccuuuuccggugugugaguccuguccccuuuacaagaagcuccgccugucgacagauacuguggaacacucccuagacaauaaagaugguccugucugccuucaggugaagccuugcacuccugaauuuuaucaaacacacuuccagcuggcauauagguugcagucucggccucguggccuagcacugguguugagcaaugugcacuucacuggagagaaagaacuggaauuucgcucuggaggggauguggaccacaguacucuagucacccucuucaagcuuuugggcuaugacguccauguucuaugugaccagacugcacaggaaaugcaagagaaacugcagaauuuugcacaguuaccugcacaccgagucacggacuccugcaucguggcacuccucucgcaugguguggagggcgccaucuaugguguggaugggaaacugcuccagcuccaagagguuuuucagcucuuugacaacgccaacugcccaagccuacagaacaaaccaaaaauguucuucauccaggccugccguggagaugagacugaucgugggguugaccaacaagauggaaagaaccacgcaggauccccugggugcgaggagagugaugccgguaaagaaaaguugccgaagaugagacugcccacgcgcucagacaugauaugcggcuaugccugccucaaagggacugccgccaugcggaacaccaaacgagguuccugguacaucgaggcucuugcucaaguguuuucugagcgggcuugugauaugcacguggccgacaugcugguuaaggugaacgcacuuaucaaggaucgggaagguuaugcuccuggcacagaauuccaccggugcaaggagaugucugaauacugcagcacucugugccgccaccucuaccuguucccaggacacccucccacaugaugucaccuccccaucauccacgccaaguggaagccacuggaccacaggaggugugauagagccuuugaucuucaggaugcacgguuucuguucugcccccucagggaugugggaaucucccagacuuguuuccugugcccaucaucucugccuuugagugugggacuccaggccagcuccuuuucugugaagcccuuugccuguagagccagccuugguuggaccuauugccaggaauguuucagcugcaguugaagagccugacaagugaaguuguaaacacagugugguuauggggagagggcauauaaauuccccauauuuguguucaguuccagcuuuuguagauggcacuuuagugauugcuuuuauuacauuaguuaagaugucugagagaccaucuccuaucuuuuauuucauucauauccuccgcccuuuuuguccuagagugagaguuuggaagguguccaaauuuaauguagacauuaucuuuuggcucugaagaagcaaacaugacuagagacgcaccuugcugcaguguccagaagcggccugugcguucccuucaguacugcagcgccacccaguggaaggacacucuuggcucguuugggcucaaggcaccgcagccugucagccaacauugccuugcauuuguaccuuauugaucuuugcccauggaagucucaaagaucuuucguugguuguuucucugagcuuuguuacugaaaugagccucguggggagcaucagagaaggccaggaagaaugguguguuucccuagacucuguaaccaccucucugucuuuuuccuuccugagaaacguccaucucucucccuuacuauucccacuuucauucaaucaaccugcacuucauaucuagauuucuagaaaagcuuccuagcuuaucucccugcuucauaucucucccuucuuuaccuucauuucauccuguuggcugcugccaccaaaucugucuagaauccugcuuuacaggaucauguaaaugcucaaagauguaauguaguucuuuguuccugcuuucucuuucaguauuaaacucuccuuugauauuauguggcuuuuauuucagugccauacauguuauuguuuucaaccuagaaaccuuuaucccugcuuaucugaaacuucccaacuucccuguucuuuaagacuuuuuuuuuuuuuuuuuuuuuuuuugagacagagucucgcucugucgcccaggcuggagggcaguggcacgaucucagcucacugcaagcuccaacucccggguucacgccauucuccugccucagccuuccaaguagcugggacuacaggugcccgccaccgugcccggcuaauuuuuuuguauuuuuaguagagacaggguuucaccauguuagccgggauggucuugaucuccugaccucaugauccacccaccucagccucccaaaguguugggauuacaggcgugagccacugcgcccgggcaagaccuuuuuuuaaaaaaaaaaaaaaaaaaacuuccauucuuucuuccuccagucuguucucacauaacagaguaguuuugguuuuuaauuuuuuuugguuguuugcuguuuuuuguuuuuuaaggugaguucucacuauguuucucagacuggucucgaacuccuggccucaagccaucuucccgccucagccucucaaauagcugggcuuacaggcaugagccaccacaccuggccaggauuugguuguuuaaauauaaaucugaucaccccccugcuuagaacccuucugcuuucuauuaccccucauuuaaaauguaaacucuucaccuugguuuaugagaacugguucuugccuuccccuugaaccucauuaaauggugauuucuugcuaagcuccagcccgaguggucuccucucagcuucuaauuuugugcucuuuccugcccuuuuccugggccuucucagcucuccacccccaccacucuugacucaggugguguccuucuuccucaagucuugacaauucccgggcccuucagucccugagcagucuacuucugugucugucaccacaucuugucuuuuccccucauugcauuuauugcaguuuauauauaugcuacuuuuacuuguucauuucugucuccccuaccaggcuguaaaugagggcagaaaccuuguuuguuuuauucaccaucauguaccaagugcuuggcacauagugggccuucauuaaauguuuguugaauaaaagagggaagaaggcaagccaaccuuagcuacaauccuaccuuuugauaaaauguuccuuuugacaauauacacggauuauuauuuguacuuuguuuuuccauguguuuugcuuuuauccacuggcauuuuuagcuccuugaagacauaucaugugugagauaacuuccuucacaucucccauggucccuagcaaaaugcuaggccuguaguagucaaggugcucaauaaauauuuguuugggugguuugugagccuugcugccaaguccugccuuugggucgacauaguauggaaguauuugagagagagaaccuuuccacucccacugccaggauuuuguauugccaucgggugccaaauaaaugcucauauuuauuaaaaaaaaaaaaaaaaaaa

SEQ ID NO: 9 - RNA, 3927 nt, Homo_sapiens
ggguggccuggugugugggcgcggcagggcgcaggcgcaggcgcagugugcguccgcgucugaggggagggaugugggggaagcgacggcccccgguuuguuugggcugugggcggugcgcagcggagagcccgggaaaagcgggaaauggcggcgccgagcgcggggucuugguccaccuuccagcacaaggagcugauggccgcugacaggggacgcaggauauugggaguguguggcaugcauccucaucaucaggaaacucuaaaaaagaaccgaguggugcuagccaaacagcuguuguugagcgaauuguuagaacaucuucuggagaaggacaucaucaccuuggaaaugagggagcucauccaggccaaagugggcaguuucagccagaauguggaacuccucaacuugcugccuaagagggguccccaagcuuuugaugccuucugugaagccuugcacuccugaauuuuaucaaacacacuuccagcuggcauauagguugcagucucggccucguggccuagcacugguguugagcaaugugcacuucacuggagagaaagaacuggaauuucgcucuggaggggauguggaccacaguacucuagucacccucuucaagcuuuugggcuaugacguccauguucuaugugaccagacugcacaggaaaugcaagagaaacugcagaauuuugcacaguuaccugcacaccgagucacggacuccugcaucguggcacuccucucgcaugguguggagggcgccaucuaugguguggaugggaaacugcuccagcuccaagagguuuuucagcucuuugacaacgccaacugcccaagccuacagaacaaaccaaaaauguucuucauccaggccugccguggagaugagacugaucgugggguugaccaacaagauggaaagaaccacgcaggauccccugggugcgaggagagugaugccgguaaagaaaaguugccgaagaugagacugcccacgcgcucagacaugauaugcggcuaugccugccucaaagggacugccgccaugcggaacaccaaacgagguuccugguacaucgaggcucuugcucaaguguuuucugagcgggcuugugauaugcacguggccgacaugcugguuaaggugaacgcacuuaucaaggaucgggaagguuaugcuccuggcacagaauuccaccggugcaaggagaugucugaauacugcagcacucugugccgccaccucuaccuguucccaggacacccucccacaugaugucaccuccccaucauccacgccaaguggaagccacuggaccacaggaggugugauagagccuuugaucuucaggaugcacgguuucuguucugcccccucagggaugugggaaucucccagacuuguuuccugugcccaucaucucugccuuugagugugggacuccaggccagcuccuuuucugugaagcccuuugccuguagagccagccuugguuggaccuauugccaggaauguuucagcugcaguugaagagccugacaagugaaguuguaaacacagugugguuauggggagagggcauauaaauuccccauauuuguguucaguuccagcuuuuguagauggcacuuuagugauugcuuuuauuacauuaguuaagaugucugagagaccaucuccuaucuuuuauuucauucauauccuccgcccuuuuuguccuagagugagaguuuggaagguguccaaauuuaauguagacauuaucuuuuggcucugaagaagcaaacaugacuagagacgcaccuugcugcaguguccagaagcggccugugcguucccuucaguacugcagcgccacccaguggaaggacacucuuggcucguuugggcucaaggcaccgcagccugucagccaacauugccuugcauuuguaccuuauugaucuuugcccauggaagucucaaagaucuuucguugguuguuucucugagcuuuguuacugaaaugagccucguggggagcaucagagaaggccaggaagaaugguguguuucccuagacucuguaaccaccucucugucuuuuuccuuccugagaaacguccaucucucucccuuacuauucccacuuucauucaaucaaccugcacuucauaucuagauuucuagaaaagcuuccuagcuuaucucccugcuucauaucucucccuucuuuaccuucauuucauccuguuggcugcugccaccaaaucugucuagaauccugcuuuacaggaucauguaaaugcucaaagauguaauguaguucuuuguuccugcuuucucuuucaguauuaaacucuccuuugauauuauguggcuuuuauuucagugccauacauguuauuguuuucaaccuagaaaccuuuaucccugcuuaucugaaacuucccaacuucccuguucuuuaagacuuuuuuuuuuuuuuuuuuuuuuuuugagacagagucucgcucugucgcccaggcuggagggcaguggcacgaucucagcucacugcaagcuccaacucccggguucacgccauucuccugccucagccuuccaaguagcugggacuacaggugcccgccaccgugcccggcuaauuuuuuuguauuuuuaguagagacaggguuucaccauguuagccgggauggucuugaucuccugaccucaugauccacccaccucagccucccaaaguguugggauuacaggcgugagccacugcgcccgggcaagaccuuuuuuuaaaaaaaaaaaaaaaaaaacuuccauucuuucuuccuccagucuguucucacauaacagaguaguuuugguuuuuaauuuuuuuugguuguuugcuguuuuuuguuuuuuaaggugaguucucacuauguuucucagacuggucucgaacuccuggccucaagccaucuucccgccucagccucucaaauagcugggcuuacaggcaugagccaccacaccuggccaggauuugguuguuuaaauauaaaucugaucaccccccugcuuagaacccuucugcuuucuauuaccccucauuuaaaauguaaacucuucaccuugguuuaugagaacugguucuugccuuccccuugaaccucauuaaauggugauuucuugcuaagcuccagcccgaguggucuccucucagcuucuaauuuugugcucuuuccugcccuuuuccugggccuucucagcucuccacccccaccacucuugacucaggugguguccuucuuccucaagucuugacaauucccgggcccuucagucccugagcagucuacuucugugucugucaccacaucuugucuuuuccccucauugcauuuauugcaguuuauauauaugcuacuuuuacuuguucauuucugucuccccuaccaggcuguaaaugagggcagaaaccuuguuuguuuuauucaccaucauguaccaagugcuuggcacauagugggccuucauuaaauguuuguugaauaaaagagggaagaaggcaagccaaccuuagcuacaauccuaccuuuugauaaaauguuccuuuugacaauauacacggauuauuauuuguacuuuguuuuuccauguguuuugcuuuuauccacuggcauuuuuagcuccuugaagacauaucaugugugagauaacuuccuucacaucucccauggucccuagcaaaaugcuaggccuguaguagucaaggugcucaauaaauauuuguuugggugguuugugagccuugcugccaaguccugccuuugggucgacauaguauggaaguauuugagagagagaaccuuuccacucccacugccaggauuuuguauugccaucgggugccaaauaaaugcucauauuuauuaaaaaaaaaaaaaaaaaaa

SEQ ID NO: 10 - RNA, 2044 nt, Homo_sapiens
caaagacaaaauaauuuacuagggaagcccuuacuaacgacccaacauccagacacaggugagggagaagaaauuuccugacagccgaagagcaacaaguaucaugauggggugcuggauuuugaaugagggucucuccaccauauuaguacucucauggcugggaauaaauuuuuaucuguuuauugacacguucuacugguaugaagaggaggagucuuuccauuacacacgaguuauuuuggguucaacacuggcuugggcacgagcauccgcacugugccugaauuuuaacugcaugcuaauucuaauaccugucagucgaaaccuuauuucauucauaagaggaacaaguauuugcugcagaggaccguggaggaggcaauuagacaaaaaccucagauuucacaaacuggucgccuaugggauagcuguuaaugcaaccauccacaucguggcgcauuucuucaaccuggaacgcuaccacuggagccaguccgaggaggcccagggacuucuggccgcacuuuccaagcugggcaacaccccuaacgagagcuaccucaacccuguccggaccuuccccacaaacacaaccacugaauugcuaaggacaauagcaggcgucaccggucuggugaucucucuggcuuuagucuugaucaugaccucgucaacugaguucaucagacaggccuccuaugaguuguucugguacacacaccauguuuucaucgucuucuuucucagccuggccauccaugggacgggucggauuguucgaggccaaacccaagacagucucucucugcacaacaucaccuucuguagagaccgcuaugcagaauggcagacaguggcccaaugccccgugccucaauuuucuggcaaggaacccucggcuuggaaauggauuuuaggcccuguggucuuguaugcaugugaaagaauaauuagguucuggcgauuucaacaagaaguugucauuaccaaggugguaagccaccccucuggaguccuggaacuucacaugaaaaagcguggcuuuaaaauggcgccagggcaguacaucuuggugcagugcccagccauaucuucgcuggaguggcaccccuucacccuuaccucugccccccaggaagacuuuuucagcgugcacauccgggcagcaggagacuggacagcagcgcuacuggaggccuuuggggcagagggacaggcccuccaggagcccuggagccugccaaggcuggcaguggacgggcccuuuggaacugcccugacagauguauuucacuacccagugugugugugcguugccgcggggaucggagucacucccuucgcugcucuucugaaaucuauaugguacaaaugcagugaggcacagaccccacugaagcugagcaagguguauuucuacuggauuugccgggaugcaagagcuuuugagugguuugcugaucucuuacucucccuggaaacacggaugagugagcaggggaaaacucacuuucugaguuaucauauauuucuuaccggcugggaugaaaaucaggcucuucacauagcuuuacacugggacgaaaauacugacgugauuacaggcuuaaagcagaagaccuucuaugggaggcccaacuggaacaaugaguucaagcagauugccuacaaucaccccagcagcaguauuggcguguucuucuguggaccuaaagcucucucgaggacacuucaaaagaugugccacuuguauucaucagcugaccccagagguguucauuucuauuacaacaaggagagcuucuagacuuuggaggucaaguccaggcauuguguuuucaaucaaguuauugauuccaaagaacuccaccaggaauuccugugacggccuguugauaugagcucccaguugggaacuggugaauaauaauuaacuauugugaacaguacacuauaccauacuuccuuagcuuauaaauaacaugucauauacaacagaacaaaaacauuuacugaaauuaaaauauauuauguuucucca

SEQ ID NO: 11 - RNA, 716 nt, Homo_sapiens
gaaacuugguguccaggggaggcccccggcggcuggagcgcggcggcagcgggcgcagaggccggagggagaggaggcgaggggcggcccgagcgcggggcgggagcgaggccagcggucaugugcccgugcccccugcaccgcggccgcggccccccggccgugugcgccugcagcgcgggucgccuggggcugcgcucguccgccgcgcagcucaccgccgcccggcucaaggcgcuaggcgacgagcugcaccagcgcaccauguggcggcgccgcgcgcggagccggagggcgccggcgcccggcgcgcuccccaccuacuggccuuggcugugcgcggccgcgcagguggcggcgcuggcggccuggcugcucggcaggcggaacuuguaggaacgcggggcuucuugguggggccggagccgagacccagccggagcgagcaacagguuggugaaaacccuguguccuuggagaaagcugguucccguuuuccagagggggagcccagagcuugaaaggccgcgguuggcacuucgagaaggaaguggagaguaaagacagcgccuggagcgaucguagaaacacagaaugggacuggggaagcccuuuggaaauccagcugcagaaacagacaccccaaugcuauuuacauacagcucuauauauauaaaaaaagaaaauaugaauauuaaaaaaaaaaaaaaaaaaaa

SEQ ID NO: 12 - RNA, 1492 nt, Homo_sapiens
cgggcgacagcagggccgcggugcaguguccgacccgagaguugcggccugagucaccggccccgcccuccggagccggacgcugcgggaggcccgggagcggcaguggaaccgacucccagaacuccggacgugugcggcgcagugagucgcagccauguuccugguuaacucguucuugaagggcggcggcggcggcggcgggggaggcgggggccugggugggggccugggaaaugugcuuggaggccugaucagcggggccgggggcggcggcggcggcggcggcggcggcggcggugguggaggcggcgguggcgguggaacggccaugcgcauccuaggcggagucaucagcgccaucagcgaggcggcugcgcaguacaacccggagcccccgcccccacgcacacauuacuccaacauugaggccaacgagagugaggagguccggcaguuccggagacucuuugcccagcuggcuggagaugacauggaggucagcgccacagaacucaugaacauucucaauaagguugugacacgacacccugaucugaagacugaugguuuuggcauugacacaugucgcagcaugguggccgugauggauagcgacaccacaggcaagcugggcuuugaggaauucaaguacuuguggaacaacaucaaaagguggcaggccauauacaaacaguucgacacugaccgaucagggaccauuugcaguagugaacucccaggugccuuugaggcagcaggguuccaccugaaugagcaucucuauaacaugaucauccgacgcuacucagaugaaagugggaacauggauuuugacaacuucaucagcugcuuggucaggcuggacgccauguuccgugccuucaaaucucuugacaaagauggcacuggacaaauccaggugaacauccaggaguggcugcagcugacuauguauuccugaacuggagccccagacccgcccccucacugccuugcuauaggagucaccuggagccucggucucucccagggccgauccugucugcagucacaucuuuguggggccugcugacccacaagcuuuuguucucucaguacuuguuacccagcuucucaacauccagggcccaauuugcccugccuggaguucccccuggcucuaggacacucuaacaagcucuguccacgggucuccccauucccaccaggcccugcacacacccacuccguaaccucuccccuguaccugugccaagccuagcacuugugaugccuccaugccccgagggcccucucucaguucugggaggaugacuccagucccugcacgcccuggcacacccuucacgguugcuacccaggcggccaagcuccagaccgugccagacccaggugccccagugccuuugucuauauucugcucccagccugccaggcccaggaggaaauaaacaugccccaguugcugaucucuaaaaaaaaaaaaaaa

SEQ ID NO: 13 - RNA, 1489 nt, Homo_sapiens
cgggcgacagcagggccgcggugcaguguccgacccgagaguugcggccugagucaccggccccgcccuccggagccggacgcugcgggaggcccgggagcggcaguggaaccgacucccagaacuccggacgugugcggcgugagucgcagccauguuccugguuaacucguucuugaagggcggcggcggcggcggcgggggaggcgggggccugggugggggccugggaaaugugcuuggaggccugaucagcggggccgggggcggcggcggcggcggcggcggcggcggcggugguggaggcggcgguggcgguggaacggccaugcgcauccuaggcggagucaucagcgccaucagcgaggcggcugcgcaguacaacccggagcccccgcccccacgcacacauuacuccaacauugaggccaacgagagugaggagguccggcaguuccggagacucuuugcccagcuggcuggagaugacauggaggucagcgccacagaacucaugaacauucucaauaagguugugacacgacacccugaucugaagacugaugguuuuggcauugacacaugucgcagcaugguggccgugauggauagcgacaccacaggcaagcugggcuuugaggaauucaaguacuuguggaacaacaucaaaagguggcaggccauauacaaacaguucgacacugaccgaucagggaccauuugcaguagugaacucccaggugccuuugaggcagcaggguuccaccugaaugagcaucucuauaacaugaucauccgacgcuacucagaugaaagugggaacauggauuuugacaacuucaucagcugcuuggucaggcuggacgccauguuccgugccuucaaaucucuugacaaagauggcacuggacaaauccaggugaacauccaggaguggcugcagcugacuauguauuccugaacuggagccccagacccgcccccucacugccuugcuauaggagucaccuggagccucggucucucccagggccgauccugucugcagucacaucuuuguggggccugcugacccacaagcuuuuguucucucaguacuuguuacccagcuucucaacauccagggcccaauuugcccugccuggaguucccccuggcucuaggacacucuaacaagcucuguccacgggucuccccauucccaccaggcccugcacacacccacuccguaaccucuccccuguaccugugccaagccuagcacuugugaugccuccaugccccgagggcccucucucaguucugggaggaugacuccagucccugcacgcccuggcacacccuucacgguugcuacccaggcggccaagcuccagaccgugccagacccaggugccccagugccuuugucuauauucugcucccagccugccaggcccaggaggaaauaaacaugccccaguugcugaucucuaaaaaaaaaaaaaaa

SEQ ID NO: 14 - RNA, 1752 nt, Homo_sapiens
agggcgcagcaggccaagggggaggugcgagcguggaccugggacgggucugggcggcucucggugguuggcacggguucgcacacccauucaagcggcaggacgcacuugucuuagcaguucucgcugaccgcgcuagcugcggcuucuacgcuccggcacucugaguucaucagcaaacgcccuggcgucuguccucaccaugccuagccuuugggaccgcuucucgucgucguccaccuccucuucgcccucguccuugccccgaacucccaccccagaucggccgccgcgcucagccugggggucggcgacccgggaggagggguuugaccgcuccacgagccuggagagcucggacugcgagucccuggacagcagcaacaguggcuucgggccggaggaagacacggcuuaccuggauggggugucguugcccgacuucgagcugcucagugacccugaggaugaacacuugugugccaaccugaugcagcugcugcaggagagccuggcccaggcgcggcugggcucucgacgcccugcgcgccugcugaugccuagccaguugguaagccaggugggcaaagaacuacugcgccuggccuacagcgagccgugcggccugcggggggcgcugcuggacgucugcguggagcagggcaagagcugccacagcgugggccagcuggcacucgaccccagccuggugcccaccuuccagcugacccucgugcugcgccuggacucacgacucuggcccaagauccaggggcuguuuagcuccgccaacucucccuuccucccuggcuucagccagucccugacgcugagcacuggcuuccgagucaucaagaagaagcuguacagcucggaacagcugcucauugaggaguguugaacuucaaccugagggggccgacagugcccuccaagacagagacgacugaacuuuugggguggagacuagaggcaggagcugagggacugauuccugugguuggaaaacugaggcagccaccuaagguggaggugggggaauaguguuucccaggaagcucauugaguugugugcggguggcugugcauuggggacacauaccccucaguacuguagcaugaaacaaaggcuuaggggccaacaaggcuuccagcuggauguguguguagcauguaccuuauuauuuuuguuacugacaguuaacaguggugugacauccagagagcagcugggcugcucccgccccagcccggcccagggugaaggaagaggcacgugcuccucagagcagccggagggaggggggaggucggaggucguggaggugguuuguguaucuuacuggucugaagggaccaaguguguuuguuguuuguuuuguaucuuguuuuucugaucggagcaucacuacugaccuguuguaggcagcuaucuuacagacgcaugaauguaagaguaggaaggggugggugucagggaucacuugggaucuuugacacuugaaaaauuacaccuggcagcugcguuuaagccuucccccaucguguacugcagaguugagcuggcaggggaggggcugagagggugggggcuggaaccccuccccgggaggagugccaucugggucuuccaucuagaacuguuuacaugaagauaagauacucacuguucaugaauacacuugauguucaaguauuaagaccuaugcaauauuuuuuacuuuucuaauaaacauguuuguuaaaacaguu

SEQ ID NO: 15 - RNA, 2607 nt, Homo_sapiens
agccggcgcaggguggccggggaggggugagcagggugccgcuggcugcuggggucugcaggucaccgaguccccaggagaggggacuccuaagaagccaccugccuguguuuacccggcagcgagcgcgcaggcccccgcgaacuccuggcagcgcucaggaaaggccguugcgccucgcgaaggaaacagagccguugaccaugguugcaacuggcaguuugagcagcaagaacccggccagcauuucagaauugcuggacuguggcuaucacccagagagccugcuaagugauuuugacuacugggauuauguuguuccugaacccaaccucaacgagguaauauuugaggaaucaacuugccagaauuugguuaaaaugcuggagaacugucuguccaaaucaaagcaaacuaaacuugguugcucaaagguccuugucccugagaaacugacccagagaauugcucaagauguccugcggcuuuccucaacggagcccugcggcuugcgagguuguguuaugcacgugaacuuggaaauugaaaauguauguaaaaagcuggauaggauugugugugauucuagcgucguaccuacuuuugagcuuacacuuguguuuaagcaggagaacugcucauggacuagcuucagggacuuuuucuuuaguagaggucgcuucuccucugguuucaggagaacucugauccucagcucaggauuucgacuuguuaagaaaaaacuuuacucacugauuggaacaacagugauugaaggguccuaaaaagggaaaauauauaaagauuauuucaugauuggguaguaaaacuauucagcuagucagcuaaagucauuuguaguuugccccaccugcccuaaauaagaaaccccaaauguagucucuuuucuuucuguguuucacauucauagcaacugcagcuaacaggcugauuuucuggccuuuggagaagugauucaaaauaguguagauuuucugcauagaucccauuuuuguacagaauugaaugggauggaauagguaagcaaaaguagaagcccauuugaguuuuacauuugauuccacaauuugguuucagguaggcuugguaauagacuauauaaaccagauuugccuauuuugauuuucauauggcuuuuuuuucucuaaguuuucagaggauuuuuuaaaucacagaaucauacuaaaugauauuuagccuaucaaaacuuccaaaagcccacaccaccaguuccugacucaaauuugaaggguuuuuagacaggaagguaggauuaaguaggugaguuuaauuaaagcuuaacccuagguaagaguaaaugagaaauauuacggcaauaauggaacugcuucacuguuucuuggugacuuccucacucuaauguuuuaaagaggcaacaaaagcuuguggugccauuucaguaaccacgguguuguuuuagaugccuuuauaagcucaguuuccccuguucuuaaguguugaauacugucuuuaaacuagaaaaaugcaaaauauugaacugauauuuuuguguguaguugauuacucuuccauugagugaaugaugaauaccugugaggauaggaaauuaguucugagaucuagucccucucugauucacuuaguaaucuauccucuuuucaguauuacaugugcuuaaucucagaugaaccauuucaccauggcaguguuaucucaucucugggcuuuucugggaauugaaguaucucuccuuaaccccaauugucaaggguaguagcuguauacuaccacuuugaauuauugaaacgggucaauuuacgaagucugcauuggcuauggagauaugguuuauaguacagccuagagaaugaaacucaccguccagauaaccaugcaugcacccagauuuuuuccaccuuggauaccugucacuagggaauaauaaaggccuuauuuuuugucuuauuccaacuaaguagaucauuaucucuuuccuuuuuuauguuaaugagagaauuuagccuccacucaacaauguucaauucagcaaggcuuucauauccuugcugugggucguggauaaggagcuuauucagguuuccugcccuagcuauuagcuccacuucacaugcuggagaccggcguagggacagauguauucauccugguguuacugaaaaacaggugugauccuguuacugauacuauaagugaccuaaaaugucacuguucaaauuagccaguguucuaacaaacuaaacucuucaaaugcuuggaaagauacuacaaagccaaucuuuauagaauugggccaagauaaaucaauguuguuuugcaugucuauuguuaagcuccaaagguucacuguguuucugccgcuguccuggaguugucaccacugacugggcaaggcuucuugggcaucgauguagaacuguuguccuuuuuccacuaacaguuaucuuugacucucuugccuguuaugcuuacaaaauggugauggcuuauggaaggcuguuaaauuaauauuccuguuaaaggaaauuaaaguuugucuauuuuugacaauaaaacauuauauauuuuuaaaaaaaaaaaaaaaaa

SEQ ID NO: 16 - RNA, 9309 nt, Homo_sapiens
augccgccgcuccuggcgccccugcucugccuggcgcugcugcccgcgcucgccgcacgaggcccgcgaugcucccagcccggugagaccugccugaauggcgggaagugugaagcggccaauggcacggaggccugcgucuguggcggggccuucgugggcccgcgaugccaggaccccaacccgugccucagcacccccugcaagaacgccgggacaugccacgugguggaccgcagaggcguggcagacuaugccugcagcugugcccugggcuucucugggccccucugccugacaccccuggacaaugccugccucaccaaccccugccgcaacgggggcaccugcgaccugcucacgcugacggaguacaagugccgcugcccgcccggcuggucagggaaaucgugccagcaggcugacccgugcgccuccaaccccugcgccaacgguggccagugccugcccuucgaggccuccuacaucugccacugcccacccagcuuccauggccccaccugccggcaggaugucaacgaguguggccagaagcccgggcuuugccgccacggaggcaccugccacaacgaggucggcuccuaccgcugcgucugccgcgccacccacacuggccccaacugcgagcggcccuacgugcccugcagccccucgcccugccagaacgggggcaccugccgccccacgggcgacgucacccacgagugugccugccugccaggcuucaccggccagaacugugaggaaaauaucgacgauuguccaggaaacaacugcaagaacgggggugccuguguggacggcgugaacaccuacaacugccgcugcccgccagaguggacaggucaguacuguaccgaggauguggacgagugccagcugaugccaaaugccugccagaacggcgggaccugccacaacacccacgguggcuacaacugcgugugugucaacggcuggacuggugaggacugcagcgagaacauugaugacugugccagcgccgccugcuuccacggcgccaccugccaugaccguguggccuccuucuacugcgaguguccccauggccgcacaggucugcugugccaccucaacgacgcaugcaucagcaaccccuguaacgagggcuccaacugcgacaccaacccugucaauggcaaggccaucugcaccugccccucgggguacacgggcccggccugcagccaggacguggaugagugcucgcugggugccaaccccugcgagcaugcgggcaagugcaucaacacgcugggcuccuucgagugccagugucugcagggcuacacgggcccccgaugcgagaucgacgucaacgagugcgucucgaacccgugccagaacgacgccaccugccuggaccagauuggggaguuccagugcaucugcaugcccggcuacgagggugugcacugcgaggucaacacagacgagugugccagcagccccugccugcacaauggccgcugccuggacaagaucaaugaguuccagugcgagugccccacgggcuucacugggcaucugugccaguacgauguggacgagugugccagcacccccugcaagaauggugccaagugccuggacggacccaacacuuacaccugugugugcacggaaggguacacggggacgcacugcgagguggacaucgaugagugcgaccccgaccccugccacuacggcuccugcaaggacggcgucgccaccuucaccugccucugccgcccaggcuacacgggccaccacugcgagaccaacaucaacgagugcuccagccagcccugccgccacgggggcaccugccaggaccgcgacaacgccuaccucugcuucugccugaaggggaccacaggacccaacugcgagaucaaccuggaugacugugccagcagccccugcgacucgggcaccugucuggacaagaucgauggcuacgagugugccugugagccgggcuacacagggagcauguguaacaucaacaucgaugagugugcgggcaaccccugccacaacgggggcaccugcgaggacggcaucaauggcuucaccugccgcugccccgagggcuaccacgaccccaccugccugucugaggucaaugagugcaacagcaaccccugcguccacggggccugccgggacagccucaacggguacaagugcgacugugacccuggguggagugggaccaacugugacaucaacaacaaugagugugaauccaacccuugugucaacggcggcaccugcaaagacaugaccaguggcuacgugugcaccugccgggagggcuucagcggucccaacugccagaccaacaucaacgagugugcguccaacccaugucugaaccagggcacguguauugacgacguugccggguacaagugcaacugccugcugcccuacacaggugccacgugugagguggugcuggccccgugugcccccagccccugcagaaacggcggggagugcaggcaauccgaggacuaugagagcuucuccugugucugccccacgggcuggcaagggcagaccugugaggucgacaucaacgagugcguucugagcccgugccggcacggcgcauccugccagaacacccacggcggcuaccgcugccacugccaggccggcuacagugggcgcaacugcgagaccgacaucgacgacugccggcccaacccgugucacaacgggggcuccugcacagacggcaucaacacggccuucugcgacugccugcccggcuuccggggcacuuucugugaggaggacaucaacgagugugccagugaccccugccgcaacggggccaacugcacggacugcguggacagcuacacgugcaccugccccgcaggcuucagcgggauccacugugagaacaacacgccugacugcacagagagcuccugcuucaacgguggcaccugcguggacggcaucaacucguucaccugccuguguccacccggcuucacgggcagcuacugccagcacgaugucaaugagugcgacucacagcccugccugcauggcggcaccugucaggacggcugcggcuccuacaggugcaccugcccccagggcuacacuggccccaacugccagaaccuugugcacuggugugacuccucgcccugcaagaacggcggcaaaugcuggcagacccacacccaguaccgcugcgagugccccagcggcuggaccggccuuuacugcgacgugcccagcguguccugugagguggcugcgcagcgacaagguguugacguugcccgccugugccagcauggagggcucuguguggacgcgggcaacacgcaccacugccgcugccaggcgggcuacacaggcagcuacugugaggaccugguggacgagugcucacccagccccugccagaacggggccaccugcacggacuaccugggcggcuacuccugcaagugcguggccggcuaccacggggugaacugcucugaggagaucgacgagugccucucccaccccugccagaacgggggcaccugccucgaccuccccaacaccuacaagugcuccugcccacggggcacucagggugugcacugugagaucaacguggacgacugcaauccccccguugaccccgugucccggagccccaagugcuuuaacaacggcaccugcguggaccaggugggcggcuacagcugcaccugcccgccgggcuucgugggugagcgcugugagggggaugucaacgagugccuguccaaucccugcgacgcccguggcacccagaacugcgugcagcgcgucaaugacuuccacugcgagugccgugcuggucacaccgggcgccgcugcgaguccgucaucaauggcugcaaaggcaagcccugcaagaaugggggcaccugcgccguggccuccaacaccgcccgcggguucaucugcaagugcccugcgggcuucgagggcgccacgugugagaaugacgcucguaccugcggcagccugcgcugccucaacggcggcacaugcaucuccggcccgcgcagccccaccugccugugccugggccccuucacgggccccgaaugccaguucccggccagcagccccugccugggcggcaaccccugcuacaaccaggggaccugugagcccacauccgagagccccuucuaccguugccugugccccgccaaauucaacgggcucuugugccacauccuggacuacagcuucggggguggggccgggcgcgacauccccccgccgcugaucgaggaggcgugcgagcugcccgagugccaggaggacgcgggcaacaaggucugcagccugcagugcaacaaccacgcgugcggcugggacggcggugacugcucccucaacuucaaugaccccuggaagaacugcacgcagucucugcagugcuggaaguacuucagugacggccacugugacagccagugcaacucagccggcugccucuucgacggcuuugacugccagcgugcggaaggccagugcaacccccuguacgaccaguacugcaaggaccacuucagcgacgggcacugcgaccagggcugcaacagcgcggagugcgagugggacgggcuggacugugcggagcauguacccgagaggcuggcggccggcacgcugguggugguggugcugaugccgccggagcagcugcgcaacagcuccuuccacuuccugcgggagcucagccgcgugcugcacaccaacguggucuucaagcgugacgcacacggccagcagaugaucuuccccuacuacggccgcgaggaggagcugcgcaagcaccccaucaagcgugccgccgagggcugggccgcaccugacgcccugcugggccaggugaaggccucgcugcucccugguggcagcgagggugggcggcggcggagggagcuggaccccauggacguccgcggcuccaucgucuaccuggagauugacaaccggcagugugugcaggccuccucgcagugcuuccagagugccaccgacguggccgcauuccugggagcgcucgccucgcugggcagccucaacauccccuacaagaucgaggccgugcagagugagaccguggagccgcccccgccggcgcagcugcacuucauguacguggcggcggccgccuuugugcuucuguucuucgugggcugcggggugcugcugucccgcaagcgccggcggcagcauggccagcucugguucccugagggcuucaaagugucugaggccagcaagaagaagcggcgggagccccucggcgaggacuccgugggccucaagccccugaagaacgcuucagacggugcccucauggacgacaaccagaaugaguggggggacgaggaccuggagaccaagaaguuccgguucgaggagcccgugguucugccugaccuggacgaccagacagaccaccggcaguggacucagcagcaccuggaugccgcugaccugcgcaugucugccauggcccccacaccgccccagggugagguugacgccgacugcauggacgucaauguccgcgggccugauggcuucaccccgcucaugaucgccuccugcagcgggggcggccuggagacgggcaacagcgaggaagaggaggacgcgccggccgucaucuccgacuucaucuaccagggcgccagccugcacaaccagacagaccgcacgggcgagaccgccuugcaccuggccgcccgcuacucacgcucugaugccgccaagcgccugcuggaggccagcgcagaugccaacauccaggacaacaugggccgcaccccgcugcaugcggcugugucugccgacgcacaaggugucuuccagauccugauccggaaccgagccacagaccuggaugcccgcaugcaugauggcacgacgccacugauccuggcugcccgccuggccguggagggcaugcuggaggaccucaucaacucacacgccgacgucaacgccguagaugaccugggcaaguccgcccugcacugggccgccgccgugaacaauguggaugccgcaguugugcuccugaagaacggggcuaacaaagauaugcagaacaacagggaggagacaccccuguuucuggccgcccgggagggcagcuacgagaccgccaaggugcugcuggaccacuuugccaaccgggacaucacggaucauauggaccgccugccgcgcgacaucgcacaggagcgcaugcaucacgacaucgugaggcugcuggacgaguacaaccuggugcgcagcccgcagcugcacggagccccgcuggggggcacgcccacccugucgcccccgcucugcucgcccaacggcuaccugggcagccucaagcccggcgugcagggcaagaagguccgcaagcccagcagcaaaggccuggccuguggaagcaaggaggccaaggaccucaaggcacggaggaagaagucccaggacggcaagggcugccugcuggacagcuccggcaugcucucgcccguggacucccuggagucaccccauggcuaccugucagacguggccucgccgccacugcugcccuccccguuccagcagucuccguccgugccccucaaccaccugccugggaugcccgacacccaccugggcaucgggcaccugaacguggcggccaagcccgagauggcggcgcugggugggggcggccggcuggccuuugagacuggcccaccucgucucucccaccugccuguggccucuggcaccagcaccguccugggcuccagcagcggaggggcccugaauuucacugugggcggguccaccaguuugaauggucaaugcgaguggcugucccggcugcagagcggcauggugccgaaccaauacaacccucugcgggggaguguggcaccaggcccccugagcacacaggcccccucccugcagcauggcaugguaggcccgcugcacaguagccuugcugccagcgcccugucccagaugaugagcuaccagggccugcccagcacccggcuggccacccagccucaccuggugcagacccagcaggugcagccacaaaacuuacagaugcagcagcagaaccugcagccagcaaacauccagcagcagcaaagccugcagccgccaccaccaccaccacagccgcaccuuggcgugagcucagcagccagcggccaccugggccggagcuuccugaguggagagccgagccaggcagacgugcagccacugggccccagcagccuggcggugcacacuauucugccccaggagagccccgcccugcccacgucgcugccauccucgcuggucccacccgugaccgcagcccaguuccugacgccccccucgcagcacagcuacuccucgccuguggacaacacccccagccaccagcuacaggugccugagcaccccuuccucaccccguccccugaguccccugaccagugguccagcucguccccgcauuccaacgucuccgacugguccgagggcgucuccagcccucccaccagcaugcagucccagaucgcccgcauuccggaggccuucaaguaaacggcgcgccccacgagaccccggcuuccuuucccaagccuucgggcgucugugugcgcucuguggaugccagggccgaccagaggagccuuuuuaaaacacauguuuuuauacaaaauaagaacgaggauuuuaauuuuuuuuaguauuuauuuauguacuuuuauuuuacacagaaacacugccuuuuuauuuauauguacuguuuuaucuggccccagguagaaacuuuuaucuauucugagaaaacaagcaaguucugagagccaggguuuuccuacguaggaugaaaagauucuucuguguuuauaaaauauaaacaaagauucaugauuuauaaaugccauuuauuuauugauuccuuuuuucaaaauccaaaaagaaaugauguuggagaagggaaguugaacgagcauaguccaaaaagcuccuggggcguccaggccgcgcccuuuccccgacgcccacccaaccccaagccagcccggccgcuccaccagcaucaccugccuguuaggagaagcugcauccagaggcaaacggaggcaaagcuggcucaccuuccgcacgcggauuaauuugcaucugaaauaggaaacaagugaaagcauauggguuagauguugccauguguuuuagaugguuucuugcaagcaugcuugugaaaauguguucucggaguguguaugccaagagugcacccaugguaccaaucaugaaucuuuguuucagguucaguauuauguaguuguucguugguuauacaaguucuuggucccuccagaaccaccccggcccccugcccguucuugaaauguaggcaucaugcaugucaaacaugagauguguggacuguggcacuugccugggucacacacggaggcauccuacccuuuucuggggaaagacacugccugggcugaccccgguggcggccccagcaccucagccugcacagugucccccagguuccgaagaagaugcuccagcaacacagccugggccccagcucgcgggacccgaccccccgugggcucccguguuuuguaggagacuugccagagccgggcacauugagcugugcaacgccgugggcugcguccuuugguccuguccccgcagcccuggcagggggcaugcggucgggcaggggcuggagggaggcgggggcugcccuugggccaccccuccuaguuugggaggagcagauuuuugcaauaccaaguauagccuauggcagaaaaaaugucuguaaauauguuuuuaaagguggauuuuguuuaaaaaaucuuaaugaaugagucuguugugugucaugccagugagggacgucagacuuggcucagcucggggagccuuagccgcccaugcacuggggacgcuccgcugccgugccgccugcacuccucagggcagccucccccggcucuacgggggccgcguggugccauccccagggggcaugaccagaugcgucccaagauguugauuuuuacuguguuuuauaaaauagaguguaguuuacagaaaaagacuuuaaaagugaucuacaugaggaacuguagaugauguauuuuuuucaucuuuuuuguuaacugauuugcaauaaaaaugauacugauggugaaaaaaaaaaaaaaa

SEQ ID NO: 17 - RNA, 2413 nt, Homo_sapiens
gggaggccggaugugaguggagcggccauuuccuguuucucugcaguuuuccucagcuuugggugguggccgcugccgggcaucggcuuccaguccgcggagggcgaggcggcguggacagcggccccggcacccagcgccccgccgcccgcaagccgcgcgcccguccgccgcgccccgagcccgccgcuuccuaucucagcgcccugccgccgccgccgcggcccagcgagcggcccugaugcaggccaucaagugugugguggugggagacggaaacaagaaucucaguguaacccgagcaaaaucgcgcgucucagcguugcuuguauagagcuguagguaaaacuugccuacugaucaguuacacaaccaaugcauuuccuggagaauauaucccuacugucuuugacaauuauucugccaauguuaugguagauggaaaaccggugaaucugggcuuaugggauacagcuggacaagaagauuaugacagauuacgcccccuauccuauccgcaaacagauguguucuuaauuugcuuuucccuugugaguccugcaucauuugaaaauguccgugcaaagugguauccugaggugcggcaccacugucccaacacucccaucauccuagugggaacuaaacuugaucuuagggaugauaaagacacgaucgagaaacugaaggagaagaagcugacucccaucaccuauccgcagggucuagccauggcuaaggagauuggugcuguaaaauaccuggagugcucggcgcucacacagcgaggccucaagacaguguuugacgaagcgauccgagcaguccucugcccgccucccgugaagaagaggaagagaaaaugccugcuguuguaaaugucucagccccucguucuugguccugucccuuggaaccuuuguacgcuuugcucaaaaaaaaacaaaaaaaaaaaacaaaaaaaaaaaacaacgguggagccuucgcacucaaugccaacuuuuuguuacagauuaauuuuuccauaaaaccauuuuuugaaccaaucaguaauuuuaagguuuuguuuguucuaaauguaagaguucagacucacauucuauuaaaauuuagcccuaaaaugacaagccuucuuaaagccuuauuuuucaaaagcgccccccccauucuuguucagauuaagaguugccaaaauaccuucugaacuacacugcauuguugugccgagaacaccgagcacugaacuuugcaaagaccuucgucuuugagaagacgguagcuucugcaguuaggaggugcagacacuugcucuccuauguaguucucagaugcguaaagcagaacagccucccgaaugaagcguugccauugaacucaccagugaguuagcagcacguguucccgacauaacauuguacuguaauggagugagcguagcagcucagcucuuuggaucagucuuugugauuucauagcgaguuuucugaccagcuuuugcggagauuuugaacagaacugcuauuuccucuaaugaagaauucuguuuagcugugggugugccggguggggugugugugaucaaaggacaaagacaguauuuugacaaaauacgaaguggagauuuacacuacauuguacaaggaaugaaagugucacggguaaaaacucuaaaagguuaauuucugucaaaugcaguagaugaugaaagaaagguugguauuaucaggaaauguuuucuuaagcuuuuccuuucucuuacaccugccaugccuccccaaauugggcauuuaauucaucuuuaaacugguuguucuguuagucgcuaacuuaguaagugcuuuucuuauagaaccccuucugacugagcaauaugccuccuuguauuauaaaaucuuucugauaaugcauuagaagguuuuuuugucgauuaguaaaagugcuuuccauguuacuuuauucagagcuaauaagugcuuuccuuaguuuucuaguaacuagguguaaaaaucauguguugcagcuuuauaguuuuuaaaauauuuuagauaauucuuaaacuaugaaccuucuuaacaucacugucuugccagauuaccgacacugucacuugaccaauacugacccucuuuaccucgcccacgcggacacacgccuccuguagucgcuuugccuauugauguuccuuugggucugugagguucuguaaacugugcuagugcugacgauguucuguacaacuuaacucacuggcgagaauacagcgugggacccuucagccacuacaacagaauuuuuuaaauugacaguugcagaauuguggaguguuuuuacauugaucuuuugcuaaugcaauuagcauuauguuuugcauguaugacuuaauaaauccuugaaucauaaaaaaaaaaaaaaa

SEQ ID NO: 18 - RNA, 636 nt, Homo_sapiens
augcaggccaucaagugugugguggugggagacggagcuguagguaaaacuugccuacugaucaguuacacaaccaaugcauuuccuggagaauauaucccuacugucuuugacaauuauucugccaauguuaugguagauggaaaaccggugaaucugggcuuaugggauacagcuggacaagaagauuaugacagauuacgcccccuauccuauccgcaaacaguuggagaaacguacgguaaggauauaaccucccggggcaaagacaagccgauugccgauguguucuuaauuugcuuuucccuugugaguccugcaucauuugaaaauguccgugcaaagugguauccugaggugcggcaccacugucccaacacucccaucauccuagugggaacuaaacuugaucuuagggaugauaaagacacgaucgagaaacugaaggagaagaagcugacucccaucaccuauccgcagggucuagccauggcuaaggagauuggugcuguaaaauaccuggagugcucggcgcucacacagcgaggccucaagacaguguuugacgaagcgauccgagcaguccucugcccgccucccgugaagaagaggaagagaaaaugccugcuguuguaa

SEQ ID NO: 19 - RNA, 579 nt, Homo_sapiens
augcaggccaucaagugugugguggugggagacggagcuguagguaaaacuugccuacugaucaguuacacaaccaaugcauuuccuggagaauauaucccuacugucuuugacaauuauucugccaauguuaugguagauggaaaaccggugaaucugggcuuaugggauacagcuggacaagaagauuaugacagauuacgcccccuauccuauccgcaaacagauguguucuuaauuugcuuuucccuugugaguccugcaucauuugaaaauguccgugcaaagugguauccugaggugcggcaccacugucccaacacucccaucauccuagugggaacuaaacuugaucuuagggaugauaaagacacgaucgagaaacugaaggagaagaagcugacucccaucaccuauccgcagggucuagccauggcuaaggagauuggugcuguaaaauaccuggagugcucggcgcucacacagcgaggccucaagacaguguuugacgaagcgauccgagcaguccucugcccgccucccgugaagaagaggaagagaaaaugccugcuguuguaa

SEQ ID NO: 20 - RNA, 1471 nt, Homo_sapiens
aucacacaggauccggagcuggugcugauaacagcggaaucccccgucuaccucucuccuugguccuggaacagcgcuacugaucaccaaguagccacaaaauauaauaaacccucagcacuugcucaguaguuuugugaaagucucaaguaaaagagacacaaacaaaaaauucuuuuucgugaagaacuccaaaaauaaaauucucuagagauaaaaaaaaaaaaaaaaggaaaaugccagcugauauaauggagaaaaauuccucguccccgguggcugcuaccccagccagugucaacacgacaccggauaaaccaaagacagcaucugagcacagaaagucaucaaagccuauuauggagaaaagacgaagagcaagaauaaaugaaagucugagccagcugaaaacacugauuuuggaugcucugaagaaagauagcucgcggcauuccaagcuggagaaggcggacauucuggaaaugacagugaagcaccuccggaaccugcagcgggcgcagaugacggcugcgcugagcacagacccaagugugcuggggaaguaccgagccggcuucagcgagugcaugaacgaggugacccgcuuccuguccacgugcgagggcguuaauaccgaggugcgcacucggcugcucggccaccuggccaacugcaugacccagaucaaugccaugaccuaccccgggcagccgcaccccgccuugcaggcgccgccaccgcccccaccgggacccggcggcccccagcacgcgccguucgcgccgccgccgccacucgugcccauccccgggggcgcggcgcccccucccggcggcgcccccugcaagcugggcagccaggcuggagaggcggcuaagguguuuggaggcuuccaggugguaccggcucccgauggccaguuugcuuuccucauucccaacggggccuucgcgcacagcggcccugucauccccgucuacaccagcaacagcggcaccuccgugggccccaacgcagugucaccuuccagcggccccucgcuuacggcggacuccauguggaggccguggcggaacugagggggcucaggccaccccuccuccuaaacuccccaacccaccucucuucccuccggacucuaaacaggaacuugaauacugggagagaagaggacuuuuuugauuaagugguuacuuuguguuuuuuuaauuucuaagaaguuacuuuuuguagagagagcuguauuaagugacugaccaugcacuauauuuguauauauuuuauauguucauauuggauugcgccuuuguauuauaaaagcucagaugacauuucguuuuuuacacgagauuucuuuuuuaugugaugccaaagauguuugaaaaugcucuuaaaauaucuuccuuuggggaaguuuauuugagaaaauauaauaaaagaaaaaaguaaaggcaaaaaaaaaaaaaaaaaa

SEQ ID NO: 21 - RNA, 1319 nt, Homo_sapiens
cgcgcuuggccuugcccgcgcccgcucgccucgucucgcccggccuccccgcgucgccucgucgccuguuccgcgccaggcauggcccccagcacuguggccguggagcugcucagccccaaagagaaaaaccgacugcggaagccggugguggagaagaugcgccgcgaccgcaucaacagcagcaucgagcagcugaagcugcugcuggagcaggaguucgcgcggcaccagcccaacuccaagcuggagaaggccgacauccuggagauggcugucagcuaccugaagcacagcaaagccuucgucgccgccgccggccccaagagccugcaccaggacuacagcgaaggcuacucguggugccugcaggaggccgugcaguuccugacgcuccacgccgccagcgacacgcagaugaagcugcuguaccacuuccagcggcccccggccgcgcccgccgcgcccgccaaggagcccaaggcgccgggcgccgcgcccccgcccgcgcucuccgccaaggccaccgccgccgccgccgccgcgcaccagcccgccugcggccucuggcggcccuggugacccggcgggaccugcgggcgcgcggcccgacgaccagagggcgagccugcuccucucgccuguagggaagcgccuucccgccgucguccgccccgggcuuggacgcgcccuucuccggaaggcucuggccccaagcuggccggcccgcaggagccccauucucagagaaugugugugcagagucccugccguuuuaggacaaucagggcccaucuucugccaagugucugaccccaugggguuguucuguguuugcauuuaagcaagugacuucugggaaguccccggccgcccgggguucuaugauauuuguagugccggggcucgcacacugcugcccccaaccuguagaggacuuucuucagggcccguagcugcugggcguaccccuggcaggcgggcugugccgcgggcacauuugccuuuugugaaggccgaacucgagcuguauccucauaggaaacagugaucaccccggacgggcguccaggacccugagggccauggccaaaaggcuccugagugugccugguggucuggcuggggcucacggugggcugucuggggagggugggugccuccacuaugauccuuaaaggauuccucuguguggguggaugcgugugggcacgacuuuguacucagaaauugaacucucagucacguggaagccacgggacugcuccgaagccgccauaauaaaaucugauuguucagcccccaaaaaaaaaaaaaaa

SEQ ID NO: 22 - RNA, 993 nt, Homo_sapiens
auuccacguucuuaacuguuccauuuuccguaucugcuucgggcuuccaccucauuuuuuucgcuuugcccauucuguuucagccagucgccaagaaucaugaaagucgccaguggcagcaccgccaccgccgccgcgggccccagcugcgcgcugaaggccggcaagacagcgagcggugcgggcgagguggugcgcugucugucugagcagagcguggccaucucgcgcugcgccgggggcgccggggcgcgccugccugcccugcuggacgagcagcagguaaacgugcugcucuacgacaugaacggcuguuacucacgccucaaggagcuggugcccacccugccccagaaccgcaaggugagcaagguggagauucuccagcacgucaucgacuacaucagggaccuucaguuggagcugaacucggaauccgaaguuggaacccccgggggccgagggcugccgguccgggcuccgcucagcacccucaacggcgagaucagcgcccugacggccgaggcggcaugcguuccugcggacgaucgcaucuugugucgcugaagcgccucccccagggaccggcggaccccagccauccagggggcaagaggaauuacgugcucugugggucucccccaacgcgccucgccggaucugagggagaacaagaccgaucggcggccacugcgcccuuaacugcauccagccuggggcugaggcugaggcacuggcgaggagagggcgcuccucucugcacaccuacuagucaccagagacuuuagggggugggauuccacucguguguuucuauuuuuugaaaagcagacauuuuaaaaaauggucacguuuggugcuucucagauuucugaggaaauugcuuuguauuguauauuacaaugaucaccgacugaaaauauuguuuuacaauaguucuguggggcuguuuuuuuguuauuaaacaaauaauuuagauggugaaaaaaaaaa

SEQ ID NO: 23 - RNA, 1234 nt, Homo_sapiens
auuccacguucuuaacuguuccauuuuccguaucugcuucgggcuuccaccucauuuuuuucgcuuugcccauucuguuucagccagucgccaagaaucaugaaagucgccaguggcagcaccgccaccgccgccgcgggccccagcugcgcgcugaaggccggcaagacagcgagcggugcgggcgagguggugcgcugucugucugagcagagcguggccaucucgcgcugcgccgggggcgccggggcgcgccugccugcccugcuggacgagcagcagguaaacgugcugcucuacgacaugaacggcuguuacucacgccucaaggagcuggugcccacccugccccagaaccgcaaggugagcaagguggagauucuccagcacgucaucgacuacaucagggaccuucaguuggagcugaacucggaauccgaaguuggaacccccgggggccgagggcugccgguccgggcuccgcucagcacccucaacggcgagaucagcgcccugacggccgaggugagauccagauccgaccacuagaucauccuuauaccgacggggaaacggaggccagagagggcgugggcgcuugcaccacuuccgucccauccuugcggguaccuggcuaugcgggggugccuaaggagccuggaaaaagcgcucccccgucgugcuuccuggggaagggggcguucgcugcgcucggagcggcgucccuuccaacccgccggucucauuucuucucguuuucacaggcggcaugcguuccugcggacgaucgcaucuugugucgcugaagcgccucccccagggaccggcggaccccagccauccagggggcaagaggaauuacgugcucugugggucucccccaacgcgccucgccggaucugagggagaacaagaccgaucggcggccacugcgcccuuaacugcauccagccuggggcugaggcugaggcacuggcgaggagagggcgcuccucucugcacaccuacuagucaccagagacuuuagggggugggauuccacucguguguuucuauuuuuugaaaagcagacauuuuaaaaaauggucacguuuggugcuucucagauuucugaggaaauugcuuuguauuguauauuacaaugaucaccgacugaaaauauuguuuuacaauaguucuguggggcuguuuuuuuguuauuaaacaaauaauuuagauggugaaaaaaaaaaaa

SEQ ID NO: 24 - RNA, 1402 nt, Homo_sapiens
ggggacgaagggaagcuccagcguguggccccggcgagugcggauaaaagccgccccgccgggcucgggcuucauucugagccgagcccggugccaagcgcagcuagcucagcaggcggcagcggcggccugagcuucagggcagccagcucccucccggucucgccuucccucgcggucagcaugaaagccuucagucccgugagguccguuaggaaaaacagccugucggaccacagccugggcaucucccggagcaaaaccccuguggacgacccgaugagccugcuauacaacaugaacgacugcuacuccaagcucaaggagcuggugcccagcaucccccagaacaagaaggugagcaagauggaaauccugcagcacgucaucgacuacaucuuggaccugcagaucgcccuggacucgcaucccacuauugucagccugcaucaccagagacccgggcagaaccaggcguccaggacgccgcugaccacccucaacacggauaucagcauccuguccuugcaggcuucugaauucccuucugaguuaaugucaaaugacagcaaagcacuguguggcugaauaagcgguguucaugauuucuuuuauucuuugcacaacaacaacaacaacaaauucacggaaucuuuuaagugcugaacuuauuuuucaaccauuucacaaggaggacaaguugaauggaccuuuuuaaaaagaaaaaaaaaauggaaggaaaacuaagaaugaucaucuucccaggguguucucuuacuuggacugugauauucguuauuuaugaaaaagacuuuuaaaugcccuuucugcaguuggaagguuuucuuuauauacuauucccaccauggggagcgaaaacguuaaaaucacaaggaauugcccaaucuaagcagacuuugccuuuuuucaaagguggagcgugaauaccagaaggauccaguauucagucacuuaaaugaagucuuuuggucagaaauuaccuuuuugacacaagccuacugaaugcuguguauauauuuauauauaaauauaucuauuugagugaaaccuugugaacucuuuaauuagaguuuucuuguauaguggcagagaugucuauuucugcauucaaaaguguaaugauguacuuauucaugcuaaacuuuuuauaaaaguuuaguuguaaacuuaacccuuuuauacaaaauaaaucaaguguguuuauugaauggugauugccugcuuuauuucagaggaccagugcuuugauuuuuauuaugcuauguuauaacugaacccaaauaaauacaaguucaaauuuauguagacuguauaagauuauaauaaaacaugucugaagucaaaaaaaaaaaaaaaaaaaaaaaaaaaaaaaaaaaaaaaa

SEQ ID NO: 25 - RNA, 1288 nt, Homo_sapiens
gcuaaaggcggacuggcagggggcagggaagcucaaagaucuggggugcugccaggaaaaagcaaauucuggaaguuaaugguuuugagugauuuuuaaauccuugcuggcggagaggcccgccucuccccgguaucagcgcuuccucauucuuugaauccgcggcuccgcggucuucggcgucagaccagccggaggaagccuguuugcaauuuaagcgggcugugaacgcccagggccggcgggggcagggccgaggcgggccauuuugaauaaagaggcgugccuuccaggcaggcucuauaagugaccgccgcggcgagcgugcgcgcguugcaggucacuguagcgggacuucuuuugguuuucuuucucuuuggggcaccucuggacucacuccccagcaugaaggcgcugagcccggugcgcggcugcuacgaggcggugugcugccugucggaacgcagucuggccaucgcccggggccgagggaagggcccggcagcugaggagccgcugagcuugcuggacgacaugaaccacugcuacucccgccugcgggaacugguacccggagucccgagaggcacucagcuuagccagguggaaauccuacagcgcgucaucgacuacauucucgaccugcagguaguccuggccgagccagccccuggacccccugauggcccccaccuucccauccagacagccgagcucacuccggaacuugucaucuccaacgacaaaaggagcuuuugccacugacucggccguguccugacaccuccagaacgcaggugcuggcgcccguucugccugggaccccgggaaccucuccugccggaagccggacggcagggaugggccccaacuucgcccugcccacuugacuucaccaaaucccuuccuggagacuaaaccuggugcucaggagcgaaggacugugaacuuguggccugaagagccagagcuagcucuggccaccagcugggcgacgucacccugcucccaccccacccccaaguucuaaggucucuucagagcguggagguguggaaggaguggcugcucuccaaacuaugccaaggcggcggcagagcuggucuucuggucuccuuggagaaagguucuguugcccugauuuaugaacucuauaauagaguauauagguuuuguaccuuuuuuacaggaaggugacuuucuguaacaaugcgauguauauuaaacuuuuuauaaaaguuaacauuuugcauaauaaacgauuuuuaaacacuuguguauaugauga

SEQ ID NO: 26 - RNA, 2422 nt, Homo_sapiens
gucagccucccuuccaccgccauauugggccacuaaaaaaagggggcucgucuuuucgggguguuuuucucccccuccccuguccccgcuugcucacggcucugcgacuccgacgccggcaagguuuggagagcggcuggguucgcgggacccgcgggcuugcacccgcccagacucggacgggcuuugccacccucuccgcuugccugguccccucuccucuccgcccucccgcucgccaguccauuugaucagcggagacucggcggccgggccggggcuuccccgcagccccugcgcgcuccuagagcucgggccguggcucgucggggucugugucuuuuggcuccgagggcagucgcugggcuuccgagagggguucgggccgcguaggggcgcuuuguuuuguucgguuuuguuuuuuugagagugcgagagaggcggucgugcagacccgggagaaagaugucaaacgugcgagugucuaacgggagcccuagccuggagcggauggacgccaggcaggcggagcaccccaagcccucggccugcaggaaccucuucggcccgguggaccacgaagaguuaacccgggacuuggagaagcacugcagagacauggaagaggcgagccagcgcaaguggaauuucgauuuucagaaucacaaaccccuagagggcaaguacgaguggcaagagguggagaagggcagcuugcccgaguucuacuacagacccccgcggccccccaaaggugccugcaaggugccggcgcaggagagccaggaugucagcgggagccgcccggcggcgccuuuaauuggggcuccggcuaacucugaggacacgcauuugguggacccaaagacugauccgucggacagccagacgggguuagcggagcaaugcgcaggaauaaggaagcgaccugcaaccgacgauucuucuacucaaaacaaaagagccaacagaacagaagaaaauguuucagacgguuccccaaaugccgguucuguggagcagacgcccaagaagccuggccucagaagacgucaaacguaaacagcucgaauuaagaauauguuuccuuguuuaucagauacaucacugcuugaugaagcaaggaagauauacaugaaaauuuuaaaaauacauaucgcugacuucauggaauggacauccuguauaagcacugaaaaacaacaacacaauaacacuaaaauuuuaggcacucuuaaaugaucugccucuaaaagcguuggauguagcauuaugcaauuagguuuuuccuuauuugcuucauuguacuaccuguguauauaguuuuuaccuuuuauguagcacauaaacuuuggggaagggagggcaggguggggcugaggaacugacguggagcgggguaugaagagcuugcuuugauuuacagcaaguagauaaauauuugacuugcaugaagagaagcaauuuuggggaaggguuugaauuguuuucuuuaaagauguaaugucccuuucagagacagcugauacuucauuuaaaaaaaucacaaaaauuugaacacuggcuaaagauaauugcuauuuauuuuuacaagaaguuuauucucauuugggagaucuggugaucucccaagcuaucuaaaguuuguuagauagcugcauguggcuuuuuuaaaaaagcaacagaaaccuauccucacugcccuccccagucucucuuaaaguuggaauuuaccaguuaauuacucagcagaauggugaucacuccagguaguuuggggcaaaaauccgaggugcuugggaguuuugaauguuaagaauugaccaucugcuuuuauuaaauuuguugacaaaauuuucucauuuucuuuucacuucgggcuguguaaacacagucaaaauaauucuaaaucccucgauauuuuuaaagaucuguaaguaacuucacauuaaaaaaugaaauauuuuuuaauuuaaagcuuacucuguccauuuauccacaggaaaguguuauuuuuaaaggaagguucauguagagaaaagcacacuuguaggauaagugaaauggauacuacaucuuuaaacaguauuucauugccuguguauggaaaaaccauuugaaguguaccuguguacauaacucuguaaaaacacugaaaaauuauacuaacuuauuuauguuaaaagauuuuuuuuaaucuagacaauauacaagccaaaguggcauguuuugugcauuuguaaaugcuguguuggguagaauagguuuuccccucuuuuguuaaauaauauggcuaugcuuaaaagguugcauacugagccaaguauaauuuuuuguaaugugugaaaaagaugccaauuauuguuacacauuaaguaaucaauaaagaaaacuuccauagcuaaaaaaaaaaaaaaaaaaa

SEQ ID NO: 27 - RNA, 1154 nt, Homo_sapiens
cgcucagggaaggcgggugcgcgccugcggggcggagaugggcagggggcggugcgugggucccagucugcaguuaagggggcaggaguggcgcugcucaccucuggugccaaagggcggcgcagcggcugccgagcucggcccuggaggcggcgagaacauggugcgcagguucuuggugacccuccggauucggcgcgcgugcggcccgccgcgagugaggguuuucgugguucacaucccgcggcucacgggggagugggcagcgccaggggcgcccgccgcuguggcccucgugcugaugcuacugaggagccagcgucuagggcagcagccgcuuccuagaagaccaggucaugaugaugggcagcgcccgaguggcggagcugcugcugcuccacggcgcggagcccaacugcgccgaccccgccacucucacccgacccgugcacgacgcugcccgggagggcuuccuggacacgcugguggugcugcaccgggccggggcgcggcuggacgugcgcgaugccuggggccgucugcccguggaccuggcugaggagcugggccaucgcgaugucgcacgguaccugcgcgcggcugcggggggcaccagaggcaguaaccaugcccgcauagaugccgcggaaggucccucagacauccccgauugaaagaaccagagaggcucugagaaaccucgggaaacuuagaucaucagucaccgaagguccuacagggccacaacugcccccgccacaacccaccccgcuuucguaguuuucauuuagaaaauagagcuuuuaaaaauguccugccuuuuaacguagauauaugccuucccccacuaccguaaauguccauuuauaucauuuuuuauauauucuuauaaaaauguaaaaaagaaaaacaccgcuucugccuuuucacuguguuggaguuuucuggagugagcacucacgcccuaagcgcacauucaugugggcauuucuugcgagccucgcagccuccggaagcugucgacuucaugacaagcauuuugugaacuagggaagcucagggggguuacuggcuucucuugagucacacugcuagcaaauggcagaaccaaagcucaaauaaaaauaaaauaauuuucauucauucacucaaaa

SEQ ID NO: 28 - RNA, 1437 nt, Homo_sapiens
cuccuccgagcacucgcucacggcguccccuugccuggaaagauaccgcggucccuccagaggauuugagggacagggucggagggggcucuuccgccagcaccggaggaagaaagaggaggggcuggcuggucaccagaggguggggcggaccgcgugcgcucggcggcugcggagagggggagagcaggcagcgggcggcggggagcagcauggagccggcggcggggagcagcauggagccuucggcugacuggcuggccacggccgcggcccggggucggguagaggaggugcgggcgcugcuggaggcgggggcgcugcccaacgcaccgaauaguuacggucggaggccgauccagguggguagagggucugcagcgggagcaggggauggcgggcgacucuggaggacgaaguuugcaggggaauuggaaucagguagcgcuucgauucuccggaaaaaggggaggcuuccuggggaguuuucagaagggguuuguaaucacagaccuccuccuggcgacgcccugggggcuugggaagccaaggaagaggaaugaggagccacgcgcguacagaucucucgaaugcugagaagaucugaaggggggaacauauuuguauuagauggaagucaugaugaugggcagcgcccgaguggcggagcugcugcugcuccacggcgcggagcccaacugcgccgaccccgccacucucacccgacccgugcacgacgcugcccgggagggcuuccuggacacgcugguggugcugcaccgggccggggcgcggcuggacgugcgcgaugccuggggccgucugcccguggaccuggcugaggagcugggccaucgcgaugucgcacgguaccugcgcgcggcugcggggggcaccagaggcaguaaccaugcccgcauagaugccgcggaaggucccucagacauccccgauugaaagaaccagagaggcucugagaaaccucgggaaacuuagaucaucagucaccgaagguccuacagggccacaacugcccccgccacaacccaccccgcuuucguaguuuucauuuagaaaauagagcuuuuaaaaauguccugccuuuuaacguagauauaugccuucccccacuaccguaaauguccauuuauaucauuuuuuauauauucuuauaaaaauguaaaaaagaaaaacaccgcuucugccuuuucacuguguuggaguuuucuggagugagcacucacgcccuaagcgcacauucaugugggcauuucuugcgagccucgcagccuccggaagcugucgacuucaugacaagcauuuugugaacuagggaagcucagggggguuacuggcuucucuugagucacacugcuagcaaauggcagaaccaaagcucaaauaaaaauaaaauaauuuucauucauucacucaaaa

SEQ ID NO: 29 - RNA, 1163 nt, Homo_sapiens
cuccuccgagcacucgcucacggcguccccuugccuggaaagauaccgcggucccuccagaggauuugagggacagggucggagggggcucuuccgccagcaccggaggaagaaagaggaggggcuggcuggucaccagaggguggggcggaccgcgugcgcucggcggcugcggagagggggagagcaggcagcgggcggcggggagcagcauggagccggcggcggggagcagcauggagccuucggcugacuggcuggccacggccgcggcccggggucggguagaggaggugcgggcgcugcuggaggcgggggcgcugcccaacgcaccgaauaguuacggucggaggccgauccaggucaugaugaugggcagcgcccgaguggcggagcugcugcugcuccacggcgcggagcccaacugcgccgaccccgccacucucacccgacccgugcacgacgcugcccgggagggcuuccuggacacgcugguggugcugcaccgggccggggcgcggcuggacgugcgcgaugccuggggccgucugcccguggaccuggcugaggagcugggccaucgcgaugucgcacgguaccugcgcgcggcugcggggggcaccagaggcaguaaccaugcccgcauagaugccgcggaaggucccucagacauccccgauugaaagaaccagagaggcucugagaaaccucgggaaacuuagaucaucagucaccgaagguccuacagggccacaacugcccccgccacaacccaccccgcuuucguaguuuucauuuagaaaauagagcuuuuaaaaauguccugccuuuuaacguagauauaugccuucccccacuaccguaaauguccauuuauaucauuuuuuauauauucuuauaaaaauguaaaaaagaaaaacaccgcuucugccuuuucacuguguuggaguuuucuggagugagcacucacgcccuaagcgcacauucaugugggcauuucuugcgagccucgcagccuccggaagcugucgacuucaugacaagcauuuugugaacuagggaagcucagggggguuacuggcuucucuugagucacacugcuagcaaauggcagaaccaaagcucaaauaaaaauaaaauaauuuucauucauucacucaaaa

SEQ ID NO: 30 - RNA, 2550 nt, Homo_sapiens
cguggaucccgagaaagaggcgcaggacgaggaggcagaacccgacuggcgcguagagcagcagcacgagcaguaggaagcagucacccggaagccugggggcgagaggcgaaguggucaggcgccgaaggccgagagcacgcggggaucggucucuucccgccgggucucuuaccggugcgagucaaagagccgcuccggccccggcccugagggaagcuccauaacugcugcuucaggagcgcccggccgucgccgccgccgccauuuucgcgcccggccgcaggggcucuugggaaggcggagucuuugggcauccgcccggggugaggggacccgaaguccugaggcgcgccggaagggcuagcggucccagcauaccccgcggccccuugggccgucucacaacucgcguccggcggagaccacaauucccggcauucguggggcagggaggagucggccucccggaauccuggucccggcgugcacuucugaaggacuucagguaccggcgugccccgcguccuacuguccgccugcucgcguccugggugccgccucugaguagggcgggcgaggaggcagccaaggcggagcugauggcugcgccgagggcggggcggggugcaggcuggagccuucgggcauggcgggcuuuggggggcauucgcugggggaggagaccccguuugaccccugaccuccgggcccugcugacgucaggaacuucugacccccgggcccgagugacuuaugggacccccagucucugggcccgguugucuguuggggucacugaaccccgagcaugccugacgucugggaccccggguccccgggcacaacugacugcggugaccccagauaccaggacccgggaggccucagagaacucuggaacccguucgcgcgcguggcuggcgguggcgcugggcgcugggggggcagugcuguuguuguuguggggcgggggucgggguccuccggccguccucgccgccgucccuagcccgccgcccgcuucuccccggagucaguacaacuucaucgcagaugugguggagaagacagcaccugccguggucuauaucgagauccuggaccggcacccuuucuugggccgcgaggucccuaucucgaacggcucaggauucgugguggcugccgaugggcucauugucaccaacgcccaugugguggcugaucggcgcagaguccgugugagacugcuaagcggcgacacguaugaggccguggucacagcuguggaucccguggcagacaucgcaacgcugaggauucagacuaaggagccucuccccacgcugccucugggacgcucagcugauguccggcaaggggaguuuguuguugccaugggaagucccuuugcacugcagaacacgaucacauccggcauuguuagcucugcucagcguccagccagagaccugggacucccccaaaccaauguggaauacauucaaacugaugcagcuauugauuuuggaaacucuggagguccccugguuaaccuggauggggaggugauuggagugaacaccaugaaggucacagcuggaaucuccuuugccaucccuucugaucgucuucgagaguuucugcaucguggggaaaagaagaauuccuccuccggaaucagugggucccagcggcgcuacauuggggugaugaugcugacccugagucccagcauccuugcugaacuacagcuucgagaaccaagcuuucccgauguucagcaugguguacucauccauaaagucauccugggcuccccugcacaccgggcuggucugcggccuggugaugugauuuuggccauuggggagcagaugguacaaaaugcugaagauguuuaugaagcuguucgaacccaaucccaguuggcagugcagauccggcggggacgagaaacacugaccuuauaugugaccccugaggucacagaaugaauagaucaccaagaguaugaggcuccugcucugauuuccuccuugccuuucuggcugagguucugagggcaccgagacagaggguuaaaugaaccagugggggcaggucccuccaaccaccagcacugacuccugggcucugaagaaucacagaaacacuuuuuauauaaaauaaaauuauaccuagcaacauauuauaguaaaaaaugaggugggagggcuggaucuuuucccccaccaaaaggcuagagguaaagcuguaucccccuaaacuuaggggagauacuggagcugaccauccugaccuccuauuaaagaaaaugagcugcugccaucuuuugugggcaguuagucaggugcugcucuuugugguguggugggcucuggucuguucugcucggugcugggccugggagcaaagauucccaugcuuggcuacagauacugacagcuggccucugaaggagggugaaaacuucugcuugacaguuccacauccauagugcauggucugaugagugcgguugcugacauggguuucuugguaagcuccugagguaauggcagccuc

SEQ ID NO: 31 - RNA, 2259 nt, Homo_sapiens
cguggaucccgagaaagaggcgcaggacgaggaggcagaacccgacuggcgcguagagcagcagcacgagcaguaggaagcagucacccggaagccugggggcgagaggcgaaguggucaggcgccgaaggccgagagcacgcggggaucggucucuucccgccgggucucuuaccggugcgagucaaagagccgcuccggccccggcccugagggaagcuccauaacugcugcuucaggagcgcccggccgucgccgccgccgccauuuucgcgcccggccgcaggggcucuugggaaggcggagucuuugggcauccgcccggggugaggggacccgaaguccugaggcgcgccggaagggcuagcggucccagcauaccccgcggccccuugggccgucucacaacucgcguccggcggagaccacaauucccggcauucguggggcagggaggagucggccucccggaauccuggucccggcgugcacuucugaaggacuucagguaccggcgugccccgcguccuacuguccgccugcucgcguccugggugccgccucugaguagggcgggcgaggaggcagccaaggcggagcugauggcugcgccgagggcggggcggggugcaggcuggagccuucgggcauggcgggcuuuggggggcauucgcugggggaggagaccccguuugaccccugaccuccgggcccugcugacgucaggaacuucugacccccgggcccgagugacuuaugggacccccagucucugggcccgguugucuguuggggucacugaaccccgagcaugccugacgucugggaccccggguccccgggcacaacugacugcggugaccccagauaccaggacccgggaggccucagagaacucuggaacccguucgcgcgcguggcuggcgguggcgcugggcgcugggggggcagugcuguuguuguuguggggcgggggucgggguccuccggccguccucgccgccgucccuagcccgccgcccgcuucuccccggagucaguacaacuucaucgcagaugugguggagaagacagcaccugccguggucuauaucgagauccuggaccggcacccuuucuugggccgcgaggucccuaucucgaacggcucaggauucgugguggcugccgaugggcucauugucaccaacgcccaugugguggcugaucggcgcagaguccgugugagacugcuaagcggcgacacguaugaggccguggucacagcuguggaucccguggcagacaucgcaacgcugaggauucagacuaaguuuggaaacucuggagguccccugguuaaccuggauggggaggugauuggagugaacaccaugaaggucacagcuggaaucuccuuugccaucccuucugaucgucuucgagaguuucugcaucguggggaaaagaagaauuccuccuccggaaucagugggucccagcggcgcuacauuggggugaugaugcugacccugagucccagggcuggucugcggccuggugaugugauuuuggccauuggggagcagaugguacaaaaugcugaagauguuuaugaagcuguucgaacccaaucccaguuggcagugcagauccggcggggacgagaaacacugaccuuauaugugaccccugaggucacagaaugaauagaucaccaagaguaugaggcuccugcucugauuuccuccuugccuuucuggcugagguucugagggcaccgagacagaggguuaaaugaaccagugggggcaggucccuccaaccaccagcacugacuccugggcucugaagaaucacagaaacacuuuuuauauaaaauaaaauuauaccuagcaacauauuauaguaaaaaaugaggugggagggcuggaucuuuucccccaccaaaaggcuagagguaaagcuguaucccccuaaacuuaggggagauacuggagcugaccauccugaccuccuauuaaagaaaaugagcugcugccaucuuuugugggcaguuagucaggugcugcucuuugugguguggugggcucuggucuguucugcucggugcugggccugggagcaaagauucccaugcuuggcuacagauacugacagcuggccucugaaggagggugaaaacuucugcuugacaguuccacauccauagugcauggucugaugagugcgguugcugacauggguuucuugguaagcuccugagguaauggcagccuc

SEQ ID NO: 32 - RNA, 2606 nt, Homo_sapiens
cuuuccgcccucuccccgccuccuuuucgggcgucccgaggccgcuccccaaccgacaaccaagaccccgcaggccacgcagcccuggagccgaggccccccgacggcggaggcgcccgcggguccccuacagccaaggucccugagugccagagguggugguguugcuuaucuucuggaaccccaugcagccagaucccaggccuagcggggcuggggccugcugccgauuccugccccugcagucacagugcccugagggggcaggggacgcggugauguacgccuccacugagugcaaggcggaggugacgcccucccagcauggcaaccgcaccuucagcuacacccuggaggaucauaccaagcaggccuuuggcaucaugaacgagcugcggcucagccagcagcugugugacgucacacugcaggucaaguaccaggaugcaccggccgcccaguucauggcccacaagguggugcuggccucauccagcccugucuucaaggccauguucaccaacgggcugcgggagcagggcauggaggugguguccauugaggguauccaccccaaggucauggagcgccucauugaauucgccuacacggccuccaucuccaugggcgagaaguguguccuccacgucaugaacggugcugucauguaccagaucgacagcguuguccgugccugcagugacuuccuggugcagcagcuggaccccagcaaugccaucggcaucgccaacuucgcugagcagauuggcuguguggaguugcaccagcgugcccgggaguacaucuacaugcauuuuggggagguggccaagcaagaggaguucuucaaccugucccacugccaacuggugacccucaucagccgggacgaccugaacgugcgcugcgaguccgaggucuuccacgccugcaucaacugggucaaguacgacugcgaacagcgacgguucuacguccaggcgcugcugcgggccgugcgcugccacucguugacgccgaacuuccugcagaugcagcugcagaagugcgagauccugcaguccgacucccgcugcaaggacuaccuggucaagaucuucgaggagcucacccugcacaagcccacgcaggugaugcccugccgggcgcccaaggugggccgccugaucuacaccgcgggcggcuacuuccgacagucgcucagcuaccuggaggcuuacaaccccagugacggcaccuggcuccgguuggcggaccugcaggugccgcggagcggccuggccggcugcguggugggcgggcuguuguacgccgugggcggcaggaacaacucgcccgacggcaacaccgacuccagcgcccuggacuguuacaaccccaugaccaaucaguggucgcccugcgcccccaugagcgugccccguaaccgcaucggggugggggucaucgauggccacaucuaugccgucggcggcucccacggcugcauccaccacaacaguguggagagguaugagccagagcgggaugaguggcacuugguggccccaaugcugacacgaaggaucggggugggcguggcuguccucaaucgucuccuuuaugccguggggggcuuugacgggacaaaccgccuuaauucagcugaguguuacuacccagagaggaacgaguggcgaaugaucacagcaaugaacaccauccgaagcggggcaggcgucugcguccugcacaacuguaucuaugcugcugggggcuaugauggucaggaccagcugaacagcguggagcgcuacgauguggaaacagagacguggacuuucguagcccccaugaagcaccggcgaagugcccuggggaucacuguccaccaggggagaaucuacguccuuggaggcuaugauggucacacguuccuggacaguguggaguguuacgacccagauacagacaccuggagcgaggugacccgaaugacaucgggccggaguggggugggcguggcugucaccauggagcccugccggaagcagauugaccagcagaacuguaccuguugaggcacuuuuguuucuugggcaaaaauacaguccaauggggaguaucauuguuuuuguacaaaaaccgggacuaaaagaaaagacagcacugcaaauaacccaucuuccgggaagggaggccaggaugccucaguguuaaaaugacaucucaaaagaaguccaaagcgggaaucaugugccccucagcggagccccgggaguguccaagacagccuggcugggaaaggggguguggaaagagcaggcuuccaggagagaggcccccaaacccucuggccggguaauaggccugggucccacucacccaugccggcagcugucaccaugugauuuauucuuggauaccugggagggggccaaugggggccucagggggaggcccccucuggaaaugugguucccagggaugggccuguacauagaagccaccggauggcacuuccccaccggauggacaguuauuuuguugauaaguaacccuguaauuuuccaaggaaaauaaagaacagacuaacuagugucuuucacccugaaaaaaaaaaaaaa

SEQ ID NO: 33 - RNA, 2577 nt, Homo_sapiens
ucugcuuagucauggugaccugcgcgcgcuccgcgccucccccacgcgcagcgauggaggcgccggggcucgggcgguggaggcggagccggagcgcggccauggcggggucccugagugccagagguggugguguugcuuaucuucuggaaccccaugcagccagaucccaggccuagcggggcuggggccugcugccgauuccugccccugcagucacagugcccugagggggcaggggacgcggugauguacgccuccacugagugcaaggcggaggugacgcccucccagcauggcaaccgcaccuucagcuacacccuggaggaucauaccaagcaggccuuuggcaucaugaacgagcugcggcucagccagcagcugugugacgucacacugcaggucaaguaccaggaugcaccggccgcccaguucauggcccacaagguggugcuggccucauccagcccugucuucaaggccauguucaccaacgggcugcgggagcagggcauggaggugguguccauugaggguauccaccccaaggucauggagcgccucauugaauucgccuacacggccuccaucuccaugggcgagaaguguguccuccacgucaugaacggugcugucauguaccagaucgacagcguuguccgugccugcagugacuuccuggugcagcagcuggaccccagcaaugccaucggcaucgccaacuucgcugagcagauuggcuguguggaguugcaccagcgugcccgggaguacaucuacaugcauuuuggggagguggccaagcaagaggaguucuucaaccugucccacugccaacuggugacccucaucagccgggacgaccugaacgugcgcugcgaguccgaggucuuccacgccugcaucaacugggucaaguacgacugcgaacagcgacgguucuacguccaggcgcugcugcgggccgugcgcugccacucguugacgccgaacuuccugcagaugcagcugcagaagugcgagauccugcaguccgacucccgcugcaaggacuaccuggucaagaucuucgaggagcucacccugcacaagcccacgcaggugaugcccugccgggcgcccaaggugggccgccugaucuacaccgcgggcggcuacuuccgacagucgcucagcuaccuggaggcuuacaaccccagugacggcaccuggcuccgguuggcggaccugcaggugccgcggagcggccuggccggcugcguggugggcgggcuguuguacgccgugggcggcaggaacaacucgcccgacggcaacaccgacuccagcgcccuggacuguuacaaccccaugaccaaucaguggucgcccugcgcccccaugagcgugccccguaaccgcaucggggugggggucaucgauggccacaucuaugccgucggcggcucccacggcugcauccaccacaacaguguggagagguaugagccagagcgggaugaguggcacuugguggccccaaugcugacacgaaggaucggggugggcguggcuguccucaaucgucuccuuuaugccguggggggcuuugacgggacaaaccgccuuaauucagcugaguguuacuacccagagaggaacgaguggcgaaugaucacagcaaugaacaccauccgaagcggggcaggcgucugcguccugcacaacuguaucuaugcugcugggggcuaugauggucaggaccagcugaacagcguggagcgcuacgauguggaaacagagacguggacuuucguagcccccaugaagcaccggcgaagugcccuggggaucacuguccaccaggggagaaucuacguccuuggaggcuaugauggucacacguuccuggacaguguggaguguuacgacccagauacagacaccuggagcgaggugacccgaaugacaucgggccggaguggggugggcguggcugucaccauggagcccugccggaagcagauugaccagcagaacuguaccuguugaggcacuuuuguuucuugggcaaaaauacaguccaauggggaguaucauuguuuuuguacaaaaaccgggacuaaaagaaaagacagcacugcaaauaacccaucuuccgggaagggaggccaggaugccucaguguuaaaaugacaucucaaaagaaguccaaagcgggaaucaugugccccucagcggagccccgggaguguccaagacagccuggcugggaaaggggguguggaaagagcaggcuuccaggagagaggcccccaaacccucuggccggguaauaggccugggucccacucacccaugccggcagcugucaccaugugauuuauucuuggauaccugggagggggccaaugggggccucagggggaggcccccucuggaaaugugguucccagggaugggccuguacauagaagccaccggauggcacuuccccaccggauggacaguuauuuuguugauaaguaacccuguaauuuuccaaggaaaauaaagaacagacuaacuagugucuuucacccugaaaaaaaaaaaaaa

SEQ ID NO: 34 - RNA, 1752 nt, Homo_sapiens
augaaucuccugccccccaagcccaaguacaauccacuccggaaugagucucugucaucgauggaggaaggggcuucuggguccacccccccggaggagcugccuuccccaccagcuucaucccuggggcccauccugccuccucugccuggggacgauagucccacuacccugugcuccuucuucccccggaugagcaaccugaggcuggccaacccggcuggggggcgcccagggucuaagggggagccaggaagggcagcugaugauggggaggggaucguaggggcagccaugccagacucaggcccccuaccccuccuccaggacaugaacaagcugaguggaggcggcgggcgcaggacucggguggaagggggccagcuugggggcgaggaguggacccgccacgggagcuuugucaauaagcccacgcggggcuggcugcaucccaacgacaaagucaugggacccgggguuuccuacuugguucgguacauggguuguguggagguccuccagucaaugcgugcccuggacuucaacacccggacucaggucaccagggaggccaucagucuggugugugaggcugugccgggugcuaagggggcgacaaggaggagaaagcccuguagccgcccgcucagcucuauccuggggaggaguaaccugaaauuugcuggaaugccaaucacucucaccgucuccaccagcagccucaaccucauggccgcagacugcaaacagaucaucgccaaccaccacaugcaaucuaucucauuugcauccggcggggauccggacacagccgaguaugucgccuauguugccaaagacccugugaaucagagagccugccacauucuggagugucccgaagggcuugcccaggaugucaucagcaccauuggccaggccuucgaguugcgcuucaaacaauaccucaggaacccacccaaacuggucaccccucaugacaggauggcuggcuuugauggcucagcaugggaugaggaggaggaagagccaccugaccaucaguacuauaaugacuucccggggaaggaaccccccuuggggggggugguagacaugaggcuucgggaaggagccgcuccaggggcugcucgacccacugcacccaaugcccagacccccagccacuugggagcuacauugccuguaggacagccuguugggggagauccagaaguccgcaaacagaugccaccuccaccacccuguccaggcagagagcuuuuugaugaucccuccuaugucaacguccagaaccuagacaaggcccggcaagcaguggguggugcugggccccccaauccugcuaucaauggcagugcaccccgggaccuguuugacaugaagcccuucgaagaugcucuucgggugccuccaccuccccagucgguguccauggcugagcagcuccgaggggagcccugguuccaugggaagcugagccggcgggaggcugaggcacugcugcagcucaauggggacuucuugguacgggagagcacgaccacaccuggccaguaugugcucacuggcuugcagagugggcagccuaagcauuugcuacugguggacccugagggugugguucggacuaaggaucaccgcuuugaaagugucagucaccuuaucagcuaccacauggacaaucacuugcccaucaucucugcgggcagcgaacugugucuacagcaaccuguggagcggaaacuguga

SEQ ID NO: 35 - RNA, 3076 nt, Homo_sapiens
guuucuccagggaggcagggcccggggagaaaguuggagcgguaaccuaagcuggcaguggcgugauccggcaccaaaucggcccgcggugcggugcggagacuccaugaggcccuggacaugaacaagcugaguggaggcggcgggcgcaggacucggguggaagggggccagcuugggggcgaggaguggacccgccacgggagcuuugucaauaagcccacgcggggcuggcugcaucccaacgacaaagucaugggacccgggguuuccuacuugguucgguacauggguuguguggagguccuccagucaaugcgugcccuggacuucaacacccggacucaggucaccagggaggccaucagucuggugugugaggcugugccgggugcuaagggggcgacaaggaggagaaagcccuguagccgcccgcucagcucuauccuggggaggaguaaccugaaauuugcuggaaugccaaucacucucaccgucuccaccagcagccucaaccucauggccgcagacugcaaacagaucaucgccaaccaccacaugcaaucuaucucauuugcauccggcggggauccggacacagccgaguaugucgccuauguugccaaagacccugugaaucagagagccugccacauucuggagugucccgaagggcuugcccaggaugucaucagcaccauuggccaggccuucgaguugcgcuucaaacaauaccucaggaacccacccaaacuggucaccccucaugacaggauggcuggcuuugauggcucagcaugggaugaggaggaggaagagccaccugaccaucaguacuauaaugacuucccggggaaggaaccccccuuggggggggugguagacaugaggcuucgggaaggagccgcuccaggggcugcucgacccacugcacccaaugcccagacccccagccacuugggagcuacauugccuguaggacagccuguugggggagauccagaaguccgcaaacagaugccaccuccaccacccuguccagcaggcagagagcuuuuugaugaucccuccuaugucaacguccagaaccuagacaaggcccggcaagcaguggguggugcugggccccccaauccugcuaucaauggcagugcaccccgggaccuguuugacaugaagcccuucgaagaugcucuucgcgugccuccaccuccccagucgguguccauggcugagcagcuccgaggggagcccugguuccaugggaagcugagccggcgggaggcugaggcacugcugcagcucaauggggacuuccugguacgggagagcacgaccacaccuggccaguaugugcucacuggcuugcagagugggcagccuaagcauuugcuacugguggacccugagggugugguucggacuaaggaucaccgcuuugaaagugucagucaccuuaucagcuaccacauggacaaucacuugcccaucaucucugcgggcagcgaacugugucuacagcaaccuguggagcggaaacugugaucugcccuagcgcucucuuccagaagaugcccuccaauccuuuccacccuauucccuaacucucgggaccucguuugggaguguucugugggcuuggccuugugucagagcugggaguagcauggacucuggguuucauauccagcugagugagaggguuugagucaaaagccugggugagaauccugccucuccccaaacauuaaucaccaaaguauuaauguacagaguggccccucaccugggccuuuccugugccaaccugaugccccuuccccaagaaggugagugcuugucauggaaaauguccuguggugacaggcccaguggaacagucacccuucugggcaagggggaacaaaucacaccucugggcuucaggguaucccagaccccucucaacacccgccccccccauguuuaaacuuugugccuuugaccaucucuuaggucuaaugauauuuuaugcaaacaguucuuggaccccugaauucaaugacagggaugccaacaccuucuuggcuucugggaccuguguucuugcugagcacccucuccgguuuggguugggauaacagaggcaggaguggcagcuguccccucucccuggggauaugcaacccuuagagauugccccagagccccacucccggccaggcgggagauggaccccucccuugcucagugccuccuggccggggccccucaccccaaggggucuguauauacauuucauaaggccugcccucccauguugcaugccuauguacucuacgccaaagugcagcccuuccuccugaagccucugcccugccucccuuucugggagggcggggugggggugacugaauuugggccucuuguacaguuaacucucccagguggauuuuguggaggugagaaaaggggcauugagacuauaaagcaguagacaauccccacauaccaucuguagaguuggaacugcauucuuuuaaaguuuuauaugcauauauuuuagggcuguagacuuacuuuccuauuuucuuuuccauugcuuauucuugagcacaaaaugauaaucaauuauuacauuuauacaucaccuuuuugacuuuuccaagcccuuuuacagcucuuggcauuuuccucgccuaggccugugagguaacugggaucgcaccuuuuauaccagagaccugaggcagaugaaauuuauuuccaucuaggacuagaaaaacuugggucucuuaccgcgagacugagaggcagaagucagcccgaaugccugucaguuucauggaggggaaacgcaaaaccugcaguuccugaguaccuucuacaggcccggcccagccuaggcccgggguggccacaccacagcaagccggcccccccucuuuuggccuuguggauaagggagaguugaccguuuucauccuggccuccuuuugcuguuuggauguuuccacgggucucacuuauaccaaagggaaaacucuucauuaaaguccguauuucuucuaaaaaaaaaaaaaaaaaaaaaaaaaaa

SEQ ID NO: 36 - RNA, 1208 nt, Homo_sapiens
ggcggcgacagggagggaggaagccuaggaguccgccgcgggacggaggccugggggaacugggaguucagcuuucugcagagggccacuaggaaccucggauugcccacggaagccagccacuuucuuugacaguccagcccaccuccucuucugcccggagaagcuccaggggcugccuuugugaucacagcaucuucacaaggaccaaaggaaaauaagauuucuuguaagaacaccgugaccacaucuuuaaaaugacccauuucguggcucccacaagauuuacaccuccacacugaggccggaagugguuuugccccuauaaaacauggcgaaaagcuuucuugucuccaaggaaacgccacguaaugagucaaagcuguggcgcacgcgcagaaguacaagcuaccggaagugauggcgccccuacuaaagccuugggguuaguacgcgugcgcagcaguuucuuccgacaguuguguugugccaaugguggagaagaaaacuucgguucgcucccaggaccccgggcagcggcgggugcuggaccgggcugcccggcagcgucgcaucaaccggcagcuggaggcccuggagaaugacaacuuccaggaugacccccacgcgggacucccucagcucggcaagagacugccucaguuugaugacgaugcggacacuggaaagaaaaagaagaaaacccgaggugaucauuuuaaacuucgcuuccgaaaaaacuuucaggcccuguuggaggagcagaacuugaguguggccgagggcccuaacuaccugacggccugugcgggacccccaucgcggccccagcgccccuucugugcugucuguggcuucccaucccccuacaccugugucagcugcggugcccgguacugcacugugcgcugucuggggacccaccaggagaccaggugucugaaguggacugugugagccugggcauucccagagaggaagggccgcugugcacugcccggccuucagaaagacagaauuucaucacccaaugcagggggagcucuuccuggaccaagggaggagccgcucauucacccaacaaaacugugucuuaucugccaggaaagaccagccucacuccugggaacugucuggcagguaggcugggccccccagugcuguuagaauaaaaagccucgugccggaaaaaaaaaaaaaaaaaaaaa

SEQ ID NO: 37 - RNA, 19 nt, Artificial
  Chemically synthesized
gcgccuuuguauuauaaaa

SEQ ID NO: 38 - RNA, 19 nt, Artificial
  Chemically synthesized
caaguaaaagagacacaaa

SEQ ID NO: 39 - RNA, 19 nt, Artificial
  Chemically synthesized
cucuaaacaggaacuugaa

SEQ ID NO: 40 - RNA, 19 nt, Artificial
  Chemically synthesized
ggugcugauaacagcggaa

SEQ ID NO: 41 - RNA, 19 nt, Artificial
  Chemically synthesized
ugccaaagauguuugaaaa

SEQ ID NO: 42 - RNA, 19 nt, Artificial
  Chemically synthesized
cuugaauacugggagagaa

SEQ ID NO: 43 - RNA, 19 nt, Artificial
  Chemically synthesized
guaaaagagacacaaacaa

SEQ ID NO: 44 - RNA, 19 nt, Artificial
  Chemically synthesized
cgugaagaacuccaaaaau

SEQ ID NO: 45 - RNA, 19 nt, Artificial
  Chemically synthesized
gaacuugaauacugggaga

SEQ ID NO: 46 - RNA, 19 nt, Artificial
  Chemically synthesized
ggacauucuggaaaugaca

SEQ ID NO: 47 - RNA, 19 nt, Artificial
  Chemically synthesized
ggagaaaagacgaagagca

SEQ ID NO: 48 - RNA, 19 nt, Artificial
  Chemically synthesized
cagcaucugagcacagaaa

SEQ ID NO: 49 - RNA, 19 nt, Artificial
  Chemically synthesized
agaaagucaucaaagccua

SEQ ID NO: 50 - RNA, 19 nt, Artificial
  Chemically synthesized
agcacagaaagucaucaaa

SEQ ID NO: 51 - RNA, 19 nt, Artificial
  Chemically synthesized
cuucccuccggacucuaaa

SEQ ID NO: 52 - RNA, 19 nt, Artificial
  Chemically synthesized
gagagaagaggacuuuuuu

SEQ ID NO: 53 - RNA, 19 nt, Artificial
  Chemically synthesized
ucaccaaguagccacaaaa

SEQ ID NO: 54 - RNA, 19 nt, Artificial
  Chemically synthesized
gccuauuauggagaaaaga

SEQ ID NO: 55 - RNA, 19 nt, Artificial
  Chemically synthesized
ggcauuccaagcuggagaa

SEQ ID NO: 56 - RNA, 19 nt, Artificial
  Chemically synthesized
ugaaaacacugauuuugga

SEQ ID NO: 57 - RNA, 19 nt, Artificial
  Chemically synthesized
ucgugaagaacuccaaaaa

SEQ ID NO: 58 - RNA, 19 nt, Artificial
  Chemically synthesized
cuuuuuuaugugaugccaa

SEQ ID NO: 59 - RNA, 19 nt, Artificial
  Chemically synthesized
guuacuuuuuguagagaga

SEQ ID NO: 60 - RNA, 19 nt, Artificial
  Chemically synthesized
agucugagccagcugaaaa

SEQ ID NO: 61 - RNA, 19 nt, Artificial
  Chemically synthesized
ccagcugauauaauggaga

SEQ ID NO: 62 - RNA, 19 nt, Artificial
  Chemically synthesized
gggagagaagaggacuuuu

SEQ ID NO: 63 - RNA, 19 nt, Artificial
  Chemically synthesized
acugcaugacccagaucaa

SEQ ID NO: 64 - RNA, 19 nt, Artificial
  Chemically synthesized
gcugauauaauggagaaaa

SEQ ID NO: 65 - RNA, 19 nt, Artificial
  Chemically synthesized
uugcuuuccucauucccaa

SEQ ID NO: 66 - RNA, 19 nt, Artificial
  Chemically synthesized
ugauuuuggaugcucugaa

SEQ ID NO: 67 - RNA, 19 nt, Artificial
  Chemically synthesized
ucaaguaaaagagacacaa

SEQ ID NO: 68 - RNA, 19 nt, Artificial
  Chemically synthesized
ggaugcucugaagaaagau

SEQ ID NO: 69 - RNA, 19 nt, Artificial
  Chemically synthesized
cuggaacagcgcuacugau

SEQ ID NO: 70 - RNA, 19 nt, Artificial
  Chemically synthesized
ggauaaaccaaagacagca

SEQ ID NO: 71 - RNA, 19 nt, Artificial
  Chemically synthesized
ggagcuggugcugauaaca

SEQ ID NO: 72 - RNA, 19 nt, Artificial
  Chemically synthesized
ugcucaguaguuuugugaa

SEQ ID NO: 73 - RNA, 19 nt, Artificial
  Chemically synthesized
agaagaggacuuuuuugau

SEQ ID NO: 74 - RNA, 19 nt, Artificial
  Chemically synthesized
ggagagaagaggacuuuuu

SEQ ID NO: 75 - RNA, 19 nt, Artificial
  Chemically synthesized
uuuggaugcucugaagaaa

SEQ ID NO: 76 - RNA, 19 nt, Artificial
  Chemically synthesized
aguaaaagagacacaaaca

SEQ ID NO: 77 - RNA, 19 nt, Artificial
  Chemically synthesized
ugcgccuuuguauuauaaa

SEQ ID NO: 78 - RNA, 19 nt, Artificial
  Chemically synthesized
gccaguuugcuuuccucau

SEQ ID NO: 79 - RNA, 19 nt, Artificial
  Chemically synthesized
uucuggaaaugacagugaa

SEQ ID NO: 80 - RNA, 19 nt, Artificial
  Chemically synthesized
cacugauuuuggaugcucu

SEQ ID NO: 81 - RNA, 19 nt, Artificial
  Chemically synthesized
guauuaagugacugaccau

SEQ ID NO: 82 - RNA, 19 nt, Artificial
  Chemically synthesized
gauuuuggaugcucugaag

SEQ ID NO: 83 - RNA, 19 nt, Artificial
  Chemically synthesized
gcaucugagcacagaaagu

SEQ ID NO: 84 - RNA, 19 nt, Artificial
  Chemically synthesized
acagcaucugagcacagaa

SEQ ID NO: 85 - RNA, 19 nt, Artificial
  Chemically synthesized
agcugauauaauggagaaa

SEQ ID NO: 86 - RNA, 19 nt, Artificial
  Chemically synthesized
gugaagaacuccaaaaaua

SEQ ID NO: 87 - RNA, 19 nt, Artificial
  Chemically synthesized
uuucgugaagaacuccaaa

SEQ ID NO: 88 - RNA, 19 nt, Artificial
  Chemically synthesized
agaucaaugccaugaccua

SEQ ID NO: 89 - RNA, 19 nt, Artificial
  Chemically synthesized
auagcucgcggcauuccaa

SEQ ID NO: 90 - RNA, 19 nt, Artificial
  Chemically synthesized
cgcuacugaucaccaagua

SEQ ID NO: 91 - RNA, 19 nt, Artificial
  Chemically synthesized
gaaagucugagccagcuga

SEQ ID NO: 92 - RNA, 19 nt, Artificial
  Chemically synthesized
accaaguagccacaaaaua

SEQ ID NO: 93 - RNA, 19 nt, Artificial
  Chemically synthesized
uggaaaugacagugaagca

SEQ ID NO: 94 - RNA, 19 nt, Artificial
  Chemically synthesized
aaagucugagccagcugaa

SEQ ID NO: 95 - RNA, 19 nt, Artificial
  Chemically synthesized
aaaagacgaagagcaagaa

SEQ ID NO: 96 - RNA, 19 nt, Artificial
  Chemically synthesized
gagaagaggacuuuuuuga

SEQ ID NO: 97 - RNA, 19 nt, Artificial
  Chemically synthesized
uggugcugauaacagcgga

SEQ ID NO: 98 - RNA, 19 nt, Artificial
  Chemically synthesized
ccaugcacuauauuuguau

SEQ ID NO: 99 - RNA, 19 nt, Artificial
  Chemically synthesized
agcugaaaacacugauuuu

SEQ ID NO: 100 - RNA, 19 nt, Artificial
  Chemically synthesized
ugaugccaaagauguuuga

SEQ ID NO: 101 - RNA, 19 nt, Artificial
  Chemically synthesized
uuuuguagagagagcugua

SEQ ID NO: 102 - RNA, 19 nt, Artificial
  Chemically synthesized
gaaagauagcucgcggcau

SEQ ID NO: 103 - RNA, 19 nt, Artificial
  Chemically synthesized
agcuguauuaagugacuga

SEQ ID NO: 104 - RNA, 19 nt, Artificial
  Chemically synthesized
cggacauucuggaaaugac

SEQ ID NO: 105 - RNA, 19 nt, Artificial
  Chemically synthesized
aagucaucaaagccuauua

SEQ ID NO: 106 - RNA, 19 nt, Artificial
  Chemically synthesized
aguuuugugaaagucucaa

SEQ ID NO: 107 - RNA, 19 nt, Artificial
  Chemically synthesized
augccaaagauguuugaaa

SEQ ID NO: 108 - RNA, 19 nt, Artificial
  Chemically synthesized
uguauuaagugacugacca

SEQ ID NO: 109 - RNA, 19 nt, Artificial
  Chemically synthesized
gaagaggacuuuuuugauu

SEQ ID NO: 110 - RNA, 19 nt, Artificial
  Chemically synthesized
uccggacucuaaacaggaa

SEQ ID NO: 111 - RNA, 19 nt, Artificial
  Chemically synthesized
caccaaguagccacaaaau

SEQ ID NO: 112 - RNA, 19 nt, Artificial
  Chemically synthesized
cugcaugacccagaucaau

SEQ ID NO: 113 - RNA, 19 nt, Artificial
  Chemically synthesized
uauggagaaaagacgaaga

SEQ ID NO: 114 - RNA, 19 nt, Artificial
  Chemically synthesized
uauuauggagaaaagacga

SEQ ID NO: 115 - RNA, 19 nt, Artificial
  Chemically synthesized
auuggauugcgccuuugua

SEQ ID NO: 116 - RNA, 19 nt, Artificial
  Chemically synthesized
ggacuuuuuugauuaagug

SEQ ID NO: 117 - RNA, 19 nt, Artificial
  Chemically synthesized
ucuucccuccggacucuaa

SEQ ID NO: 118 - RNA, 19 nt, Artificial
  Chemically synthesized
agccuauuauggagaaaag

SEQ ID NO: 119 - RNA, 19 nt, Artificial
  Chemically synthesized
agagcuguauuaagugacu

SEQ ID NO: 120 - RNA, 19 nt, Artificial
  Chemically synthesized
uuuuggaugcucugaagaa

SEQ ID NO: 121 - RNA, 19 nt, Artificial
  Chemically synthesized
aagucugagccagcugaaa

SEQ ID NO: 122 - RNA, 19 nt, Artificial
  Chemically synthesized
acgacaccggauaaaccaa

SEQ ID NO: 123 - RNA, 19 nt, Artificial
  Chemically synthesized
aaaugccagcugauauaau

SEQ ID NO: 124 - RNA, 19 nt, Artificial
  Chemically synthesized
auugcgccuuuguauuaua

SEQ ID NO: 125 - RNA, 19 nt, Artificial
  Chemically synthesized
ugaauacugggagagaaga

SEQ ID NO: 126 - RNA, 19 nt, Artificial
  Chemically synthesized
acuugaauacugggagaga

SEQ ID NO: 127 - RNA, 19 nt, Artificial
  Chemically synthesized
aaagccuauuauggagaaa

SEQ ID NO: 128 - RNA, 19 nt, Artificial
  Chemically synthesized
uaguuuugugaaagucuca

SEQ ID NO: 129 - RNA, 19 nt, Artificial
  Chemically synthesized
gauguuugaaaaugcucuu

SEQ ID NO: 130 - RNA, 19 nt, Artificial
  Chemically synthesized
gugguuacuuuguguuuuu

SEQ ID NO: 131 - RNA, 19 nt, Artificial
  Chemically synthesized
cugggagagaagaggacuu

SEQ ID NO: 132 - RNA, 19 nt, Artificial
  Chemically synthesized
acgugcgagggcguuaaua

SEQ ID NO: 133 - RNA, 19 nt, Artificial
  Chemically synthesized
agucaucaaagccuauuau

SEQ ID NO: 134 - RNA, 19 nt, Artificial
  Chemically synthesized
aaggcggacauucuggaaa

SEQ ID NO: 135 - RNA, 19 nt, Artificial
  Chemically synthesized
aagccuauuauggagaaaa

SEQ ID NO: 136 - RNA, 19 nt, Artificial
  Chemically synthesized
cucagaugacauuucguuu

SEQ ID NO: 137 - RNA, 19 nt, Artificial
  Chemically synthesized
gccaaagauguuugaaaau

SEQ ID NO: 138 - RNA, 19 nt, Artificial
  Chemically Synthesized
ccucagcacuugcucagua

SEQ ID NO: 139 - RNA, 19 nt, Artificial
  Chemically Synthesized
uagagagagcuguauuaag

SEQ ID NO: 140 - RNA, 19 nt, Artificial
  Chemically Synthesized
ucuaaacaggaacuugaau

SEQ ID NO: 141 - RNA, 19 nt, Artificial
  Chemically Synthesized
cggacucuaaacaggaacu

SEQ ID NO: 142 - RNA, 19 nt, Artificial
  Chemically Synthesized
ucuccuugguccuggaaca

SEQ ID NO: 143 - RNA, 19 nt, Artificial
  Chemically Synthesized
caaagauguuugaaaaugc

SEQ ID NO: 144 - RNA, 19 nt, Artificial
  Chemically Synthesized
uuucguuuuuuacacgaga

SEQ ID NO: 145 - RNA, 19 nt, Artificial
  Chemically Synthesized
agugacugaccaugcacua

SEQ ID NO: 146 - RNA, 19 nt, Artificial
  Chemically Synthesized
ggaacuugaauacugggag

SEQ ID NO: 147 - RNA, 19 nt, Artificial
  Chemically Synthesized
gcuucagcgagugcaugaa

SEQ ID NO: 148 - RNA, 19 nt, Artificial
  Chemically Synthesized
gcggacauucuggaaauga

SEQ ID NO: 149 - RNA, 19 nt, Artificial
  Chemically Synthesized
gaaaacacugauuuuggau

SEQ ID NO: 150 - RNA, 19 nt, Artificial
  Chemically Synthesized
aaagacgaagagcaagaau

SEQ ID NO: 151 - RNA, 19 nt, Artificial
  Chemically Synthesized
cagaugacauuucguuuuu

SEQ ID NO: 152 - RNA, 19 nt, Artificial
  Chemically Synthesized
agcucagaugacauuucgu

SEQ ID NO: 153 - RNA, 19 nt, Artificial
  Chemically Synthesized
gaauacugggagagaagag

SEQ ID NO: 154 - RNA, 19 nt, Artificial
  Chemically Synthesized
acaggaacuugaauacugg

SEQ ID NO: 155 - RNA, 19 nt, Artificial
  Chemically Synthesized
ggccaguuugcuuuccuca

SEQ ID NO: 156 - RNA, 19 nt, Artificial
  Chemically Synthesized
ugaucaccaaguagccaca

SEQ ID NO: 157 - RNA, 19 nt, Artificial
  Chemically Synthesized
aagacagcaucugagcaca

SEQ ID NO: 158 - RNA, 19 nt, Artificial
  Chemically Synthesized
accggauaaaccaaagaca

SEQ ID NO: 159 - RNA, 19 nt, Artificial
  Chemically Synthesized
gccagcugauauaauggag

SEQ ID NO: 160 - RNA, 19 nt, Artificial
  Chemically Synthesized
aaaaugccagcugauauaa

SEQ ID NO: 161 - RNA, 19 nt, Artificial
  Chemically Synthesized
aagucucaaguaaaagaga

SEQ ID NO: 162 - RNA, 19 nt, Artificial
  Chemically Synthesized
aacgcagugucaccuucca

SEQ ID NO: 163 - RNA, 19 nt, Artificial
  Chemically Synthesized
gacccagaucaaugccaug

SEQ ID NO: 164 - RNA, 19 nt, Artificial
  Chemically Synthesized
gagugcaugaacgagguga

SEQ ID NO: 165 - RNA, 19 nt, Artificial
  Chemically Synthesized
agaaggcggacauucugga

SEQ ID NO: 166 - RNA, 19 nt, Artificial
  Chemically Synthesized
agaaagauagcucgcggca

SEQ ID NO: 167 - RNA, 19 nt, Artificial
  Chemically Synthesized
gacagcaucugagcacaga

SEQ ID NO: 168 - RNA, 19 nt, Artificial
  Chemically Synthesized
ccggauaaaccaaagacag

SEQ ID NO: 169 - RNA, 19 nt, Artificial
  Chemically Synthesized
cacgacaccggauaaacca

SEQ ID NO: 170 - RNA, 19 nt, Artificial
  Chemically Synthesized
gcacuugcucaguaguuuu

SEQ ID NO: 171 - RNA, 19 nt, Artificial
  Chemically Synthesized
agauguuugaaaaugcucu

SEQ ID NO: 172 - RNA, 19 nt, Artificial
  Chemically Synthesized
auaaaagcucagaugacau

SEQ ID NO: 173 - RNA, 19 nt, Artificial
  Chemically Synthesized
gaaguuacuuuuuguagag

SEQ ID NO: 174 - RNA, 19 nt, Artificial
  Chemically Synthesized
cuccggacucuaaacagga

SEQ ID NO: 175 - RNA, 19 nt, Artificial
  Chemically Synthesized
gcgcuacugaucaccaagu

SEQ ID NO: 176 - RNA, 19 nt, Artificial
  Chemically Synthesized
ccagcugaaaacacugauu

SEQ ID NO: 177 - RNA, 19 nt, Artificial
  Chemically Synthesized
auuauggagaaaagacgaa

SEQ ID NO: 178 - RNA, 19 nt, Artificial
  Chemically Synthesized
caaagacagcaucugagca

SEQ ID NO: 179 - RNA, 19 nt, Artificial
  Chemically Synthesized
gucucaaguaaaagagaca

SEQ ID NO: 180 - RNA, 19 nt, Artificial
  Chemically Synthesized
ucaguaguuuugugaaagu

SEQ ID NO: 181 - RNA, 19 nt, Artificial
  Chemically Synthesized
gugacugaccaugcacuau

SEQ ID NO: 182 - RNA, 19 nt, Artificial
  Chemically Synthesized
ugacccagaucaaugccau

SEQ ID NO: 183 - RNA, 19 nt, Artificial
  Chemically Synthesized
gaagaaagauagcucgcgg

SEQ ID NO: 184 - RNA, 19 nt, Artificial
  Chemically Synthesized
acaccggauaaaccaaaga

SEQ ID NO: 185 - RNA, 19 nt, Artificial
  Chemically Synthesized
uuuucgugaagaacuccaa

SEQ ID NO: 186 - RNA, 19 nt, Artificial
  Chemically Synthesized
aaguaaaagagacacaaac

SEQ ID NO: 187 - RNA, 19 nt, Artificial
  Chemically Synthesized
cgccuuuguauuauaaaag

SEQ ID NO: 188 - RNA, 19 nt, Artificial
  Chemically Synthesized
auauaauaaacccucagca

SEQ ID NO: 189 - RNA, 19 nt, Artificial
  Chemically Synthesized
auacugggagagaagagga

SEQ ID NO: 190 - RNA, 19 nt, Artificial
  Chemically Synthesized
ggcggacauucuggaaaug

SEQ ID NO: 191 - RNA, 19 nt, Artificial
  Chemically Synthesized
uggagaaggcggacauucu

SEQ ID NO: 192 - RNA, 19 nt, Artificial
  Chemically Synthesized
aguaguuuugugaaagucu

SEQ ID NO: 193 - RNA, 19 nt, Artificial
  Chemically Synthesized
gaugccaaagauguuugaa

SEQ ID NO: 194 - RNA, 19 nt, Artificial
  Chemically Synthesized
augugaugccaaagauguu

SEQ ID NO: 195 - RNA, 19 nt, Artificial
  Chemically Synthesized
uuggauugcgccuuuguau

SEQ ID NO: 196 - RNA, 19 nt, Artificial
  Chemically Synthesized
ucagcgagugcaugaacga

SEQ ID NO: 197 - RNA, 19 nt, Artificial
  Chemically Synthesized
ccuauuauggagaaaagac

SEQ ID NO: 198 - RNA, 19 nt, Artificial
  Chemically Synthesized
agccagugucaacacgaca

SEQ ID NO: 199 - RNA, 19 nt, Artificial
  Chemically Synthesized
guaguuuugugaaagucuc

SEQ ID NO: 200 - RNA, 19 nt, Artificial
  Chemically Synthesized
cuaagguguuuggaggcuu

SEQ ID NO: 201 - RNA, 19 nt, Artificial
  Chemically Synthesized
agugcaugaacgaggugac

SEQ ID NO: 202 - RNA, 19 nt, Artificial
  Chemically Synthesized
aaaugacagugaagcaccu

SEQ ID NO: 203 - RNA, 19 nt, Artificial
  Chemically Synthesized
agaaaagacgaagagcaag

SEQ ID NO: 204 - RNA, 19 nt, Artificial
  Chemically Synthesized
uucgugaagaacuccaaaa

SEQ ID NO: 205 - RNA, 19 nt, Artificial
  Chemically Synthesized
ucuuuuuuaugugaugcca

SEQ ID NO: 206 - RNA, 19 nt, Artificial
  Chemically Synthesized
cugaccaugcacuauauuu

SEQ ID NO: 207 - RNA, 19 nt, Artificial
  Chemically Synthesized
agugguuacuuuguguuuu

SEQ ID NO: 208 - RNA, 19 nt, Artificial
  Chemically Synthesized
agagaagaggacuuuuuug

SEQ ID NO: 209 - RNA, 19 nt, Artificial
  Chemically Synthesized
agguguuuggaggcuucca

SEQ ID NO: 210 - RNA, 19 nt, Artificial
  Chemically Synthesized
ugagccagcugaaaacacu

SEQ ID NO: 211 - RNA, 19 nt, Artificial
  Chemically Synthesized
cagaaagucaucaaagccu

SEQ ID NO: 212 - RNA, 19 nt, Artificial
  Chemically Synthesized
gcucuuaaaauaucuuccu

SEQ ID NO: 213 - RNA, 19 nt, Artificial
  Chemically Synthesized
guuaauaccgaggugcgca

SEQ ID NO: 214 - RNA, 19 nt, Artificial
  Chemically Synthesized
cugauuuuggaugcucuga

SEQ ID NO: 215 - RNA, 19 nt, Artificial
  Chemically Synthesized
gucugagccagcugaaaac

SEQ ID NO: 216 - RNA, 19 nt, Artificial
  Chemically Synthesized
ugccagcugauauaaugga

SEQ ID NO: 217 - RNA, 19 nt, Artificial
  Chemically Synthesized
aagugguuacuuuguguuu

SEQ ID NO: 218 - RNA, 19 nt, Artificial
  Chemically Synthesized
caggaacuugaauacuggg

SEQ ID NO: 219 - RNA, 19 nt, Artificial
  Chemically Synthesized
ggacucuaaacaggaacuu

SEQ ID NO: 220 - RNA, 19 nt, Artificial
  Chemically Synthesized
aucaccaaguagccacaaa

SEQ ID NO: 221 - RNA, 19 nt, Artificial
  Chemically Synthesized
gaucaccaaguagccacaa

SEQ ID NO: 222 - RNA, 19 nt, Artificial
  Chemically Synthesized
aaaugaaagucugagccag

SEQ ID NO: 223 - RNA, 19 nt, Artificial
  Chemically Synthesized
gaauaaaugaaagucugag

SEQ ID NO: 224 - RNA, 19 nt, Artificial
  Chemically Synthesized
cuauuauggagaaaagacg

SEQ ID NO: 225 - RNA, 19 nt, Artificial
  Chemically Synthesized
aucugagcacagaaaguca

SEQ ID NO: 226 - RNA, 19 nt, Artificial
  Chemically Synthesized
guuuugugaaagucucaag

SEQ ID NO: 227 - RNA, 19 nt, Artificial
  Chemically Synthesized
cauuucguuuuuuacacga

SEQ ID NO: 228 - RNA, 19 nt, Artificial
  Chemically Synthesized
aggaacuugaauacuggga

SEQ ID NO: 229 - RNA, 19 nt, Artificial
  Chemically Synthesized
ccggacucuaaacaggaac

SEQ ID NO: 230 - RNA, 19 nt, Artificial
  Chemically Synthesized
uuugcuuuccucauuccca

SEQ ID NO: 231 - RNA, 19 nt, Artificial
  Chemically Synthesized
ggaaaugacagugaagcac

SEQ ID NO: 232 - RNA, 19 nt, Artificial
  Chemically Synthesized
gacauuucguuuuuuacac

SEQ ID NO: 233 - RNA, 19 nt, Artificial
  Chemically Synthesized
auuuuggaugcucugaaga

SEQ ID NO: 234 - RNA, 19 nt, Artificial
  Chemically Synthesized
uaaaugaaagucugagcca

SEQ ID NO: 235 - RNA, 19 nt, Artificial
  Chemically Synthesized
ugucaacacgacaccggau

SEQ ID NO: 236 - RNA, 19 nt, Artificial
  Chemically Synthesized
cuugcucaguaguuuugug

SEQ ID NO: 237 - RNA, 19 nt, Artificial
  Chemically Synthesized
uuuuaugugaugccaaaga

SEQ ID NO: 238 - RNA, 19 nt, Artificial
  Chemically Synthesized
cguuuuuuacacgagauuu

SEQ ID NO: 239 - RNA, 19 nt, Artificial
  Chemically Synthesized
uguucauauuggauugcgc

SEQ ID NO: 240 - RNA, 19 nt, Artificial
  Chemically Synthesized
acugaccaugcacuauauu

SEQ ID NO: 241 - RNA, 19 nt, Artificial
  Chemically Synthesized
uugaauacugggagagaag

SEQ ID NO: 242 - RNA, 19 nt, Artificial
  Chemically Synthesized
cucaaguaaaagagacaca

SEQ ID NO: 243 - RNA, 19 nt, Artificial
  Chemically Synthesized
uuguagagagagcuguauu

SEQ ID NO: 244 - RNA, 19 nt, Artificial
  Chemically Synthesized
aguuacuuuuuguagagag

SEQ ID NO: 245 - RNA, 19 nt, Artificial
  Chemically Synthesized
ugauuaagugguuacuuug

SEQ ID NO: 246 - RNA, 19 nt, Artificial
  Chemically Synthesized
gaggacuuuuuugauuaag

SEQ ID NO: 247 - RNA, 19 nt, Artificial
  Chemically Synthesized
gccagcugaaaacacugau

SEQ ID NO: 248 - RNA, 19 nt, Artificial
  Chemically Synthesized
ucagcacuugcucaguagu

SEQ ID NO: 249 - RNA, 19 nt, Artificial
  Chemically Synthesized
gauuaagugguuacuuugu

SEQ ID NO: 250 - RNA, 19 nt, Artificial
  Chemically Synthesized
uaagguguuuggaggcuuc

SEQ ID NO: 251 - RNA, 19 nt, Artificial
  Chemically Synthesized
gcuacugaucaccaaguag

SEQ ID NO: 252 - RNA, 19 nt, Artificial
  Chemically Synthesized
acugauuuuggaugcucug

SEQ ID NO: 253 - RNA, 19 nt, Artificial
  Chemically Synthesized
cugaaaacacugauuuugg

SEQ ID NO: 254 - RNA, 19 nt, Artificial
  Chemically Synthesized
gugcugauaacagcggaau

SEQ ID NO: 255 - RNA, 19 nt, Artificial
  Chemically Synthesized
uuaugugaugccaaagaug

SEQ ID NO: 256 - RNA, 19 nt, Artificial
  Chemically Synthesized
uggauugcgccuuuguauu

SEQ ID NO: 257 - RNA, 19 nt, Artificial
  Chemically Synthesized
gcuguauuaagugacugac

SEQ ID NO: 258 - RNA, 19 nt, Artificial
  Chemically Synthesized
acugggagagaagaggacu

SEQ ID NO: 259 - RNA, 19 nt, Artificial
  Chemically Synthesized
agcuggugcugauaacagc

SEQ ID NO: 260 - RNA, 19 nt, Artificial
  Chemically Synthesized
ucaaagccuauuauggaga

SEQ ID NO: 261 - RNA, 19 nt, Artificial
  Chemically Synthesized
cggauaaaccaaagacagc

SEQ ID NO: 262 - RNA, 19 nt, Artificial
  Chemically Synthesized
ucuuuuucgugaagaacuc

SEQ ID NO: 263 - RNA, 19 nt, Artificial
  Chemically Synthesized
ugaaagucucaaguaaaag

SEQ ID NO: 264 - RNA, 19 nt, Artificial
  Chemically Synthesized
uuuugugaaagucucaagu

SEQ ID NO: 265 - RNA, 19 nt, Artificial
  Chemically Synthesized
cucaguaguuuugugaaag

SEQ ID NO: 266 - RNA, 19 nt, Artificial
  Chemically Synthesized
gacucuaaacaggaacuug

SEQ ID NO: 267 - RNA, 19 nt, Artificial
  Chemically Synthesized
uuggaugcucugaagaaag

SEQ ID NO: 268 - RNA, 19 nt, Artificial
  Chemically Synthesized
uauuggauugcgccuuugu

SEQ ID NO: 269 - RNA, 19 nt, Artificial
  Chemically Synthesized
gagagcuguauuaagugac

SEQ ID NO: 270 - RNA, 19 nt, Artificial
  Chemically Synthesized
ucuggaaaugacagugaag

SEQ ID NO: 271 - RNA, 19 nt, Artificial
  Chemically Synthesized
agcaucugagcacagaaag

SEQ ID NO: 272 - RNA, 19 nt, Artificial
  Chemically Synthesized
ccaaagauguuugaaaaug

SEQ ID NO: 273 - RNA, 19 nt, Artificial
  Chemically Synthesized
ucagaugacauuucguuuu

SEQ ID NO: 274 - RNA, 19 nt, Artificial
  Chemically Synthesized
acagcgcuacugaucacca

SEQ ID NO: 275 - RNA, 19 nt, Artificial
  Chemically Synthesized
ucugagcacagaaagucau

SEQ ID NO: 276 - RNA, 19 nt, Artificial
  Chemically Synthesized
agcacuugcucaguaguuu

SEQ ID NO: 277 - RNA, 19 nt, Artificial
  Chemically Synthesized
cagcacuugcucaguaguu

SEQ ID NO: 278 - RNA, 19 nt, Artificial
  Chemically Synthesized
auaauaaacccucagcacu

SEQ ID NO: 279 - RNA, 19 nt, Artificial
  Chemically Synthesized
uguuuggaggcuuccaggu

SEQ ID NO: 280 - RNA, 19 nt, Artificial
  Chemically Synthesized
cagcugaaaacacugauuu

SEQ ID NO: 281 - RNA, 19 nt, Artificial
  Chemically Synthesized
ucaucaaagccuauuaugg

SEQ ID NO: 282 - RNA, 19 nt, Artificial
  Chemically Synthesized
acuugcucaguaguuuugu

SEQ ID NO: 283 - RNA, 19 nt, Artificial
  Chemically Synthesized
cuguauuaagugacugacc

SEQ ID NO: 284 - RNA, 19 nt, Artificial
  Chemically Synthesized
uuuguagagagagcuguau

SEQ ID NO: 285 - RNA, 19 nt, Artificial
  Chemically Synthesized
cuuuuuguagagagagcug

SEQ ID NO: 286 - RNA, 19 nt, Artificial
  Chemically Synthesized
uacugggagagaagaggac

SEQ ID NO: 287 - RNA, 19 nt, Artificial
  Chemically Synthesized
ccagaucaaugccaugacc

SEQ ID NO: 288 - RNA, 19 nt, Artificial
  Chemically Synthesized
gcaugacccagaucaaugc

SEQ ID NO: 289 - RNA, 19 nt, Artificial
  Chemically Synthesized
cucugaagaaagauagcuc

SEQ ID NO: 290 - RNA, 19 nt, Artificial
  Chemically Synthesized
gcugaaaacacugauuuug

SEQ ID NO: 291 - RNA, 19 nt, Artificial
  Chemically Synthesized
caccggauaaaccaaagac

SEQ ID NO: 292 - RNA, 19 nt, Artificial
  Chemically Synthesized
caguaguuuugugaaaguc

SEQ ID NO: 293 - RNA, 19 nt, Artificial
  Chemically Synthesized
guuuuuuacacgagauuuc

SEQ ID NO: 294 - RNA, 19 nt, Artificial
  Chemically Synthesized
aacccucagcacuugcuca

SEQ ID NO: 295 - RNA, 19 nt, Artificial
  Chemically Synthesized
aaaagcucagaugacauuu

SEQ ID NO: 296 - RNA, 19 nt, Artificial
  Chemically Synthesized
uuauaaaagcucagaugac

SEQ ID NO: 297 - RNA, 19 nt, Artificial
  Chemically Synthesized
ugcuuuccucauucccaac

SEQ ID NO: 298 - RNA, 19 nt, Artificial
  Chemically Synthesized
cgauggccaguuugcuuuc

SEQ ID NO: 299 - RNA, 19 nt, Artificial
  Chemically Synthesized
cccagaucaaugccaugac

SEQ ID NO: 300 - RNA, 19 nt, Artificial
  Chemically Synthesized
gcucugaagaaagauagcu

SEQ ID NO: 301 - RNA, 19 nt, Artificial
  Chemically Synthesized
agcgcuacugaucaccaag

SEQ ID NO: 302 - RNA, 19 nt, Artificial
  Chemically Synthesized
augaaagucugagccagcu

SEQ ID NO: 303 - RNA, 19 nt, Artificial
  Chemically Synthesized
aucaaagccuauuauggag

SEQ ID NO: 304 - RNA, 19 nt, Artificial
  Chemically Synthesized
ugagcacagaaagucauca

SEQ ID NO: 305 - RNA, 19 nt, Artificial
  Chemically Synthesized
cucagcacuugcucaguag

SEQ ID NO: 306 - RNA, 19 nt, Artificial
  Chemically Synthesized
uauaauaaacccucagcac

SEQ ID NO: 307 - RNA, 19 nt, Artificial
  Chemically Synthesized
gacuuuuuugauuaagugg

SEQ ID NO: 308 - RNA, 19 nt, Artificial
  Chemically Synthesized
gcuaagguguuuggaggcu

SEQ ID NO: 309 - RNA, 19 nt, Artificial
  Chemically Synthesized
agggcguuaauaccgaggu

SEQ ID NO: 310 - RNA, 19 nt, Artificial
  Chemically Synthesized
ugagcacagacccaagugu

SEQ ID NO: 311 - RNA, 19 nt, Artificial
  Chemically Synthesized
gucaucaaagccuauuaug

SEQ ID NO: 312 - RNA, 19 nt, Artificial
  Chemically Synthesized
uaaaccaaagacagcaucu

SEQ ID NO: 313 - RNA, 19 nt, Artificial
  Chemically Synthesized
ggagaaaaauuccucgucc

SEQ ID NO: 314 - RNA, 19 nt, Artificial
  Chemically Synthesized
uugcucaguaguuuuguga

SEQ ID NO: 315 - RNA, 19 nt, Artificial
  Chemically Synthesized
gagcuguauuaagugacug

SEQ ID NO: 316 - RNA, 19 nt, Artificial
  Chemically Synthesized
gcauuccaagcuggagaag

SEQ ID NO: 317 - RNA, 19 nt, Artificial
  Chemically Synthesized
ucugagccagcugaaaaca

SEQ ID NO: 318 - RNA, 19 nt, Artificial
  Chemically Synthesized
gccuuuguauuauaaaagc

SEQ ID NO: 319 - RNA, 19 nt, Artificial
  Chemically Synthesized
aagugacugaccaugcacu

SEQ ID NO: 320 - RNA, 19 nt, Artificial
  Chemically Synthesized
gagccagcugaaaacacug

SEQ ID NO: 321 - RNA, 19 nt, Artificial
  Chemically Synthesized
aaugaaagucugagccagc

SEQ ID NO: 322 - RNA, 19 nt, Artificial
  Chemically Synthesized
uggagaaaagacgaagagc

SEQ ID NO: 323 - RNA, 19 nt, Artificial
  Chemically Synthesized
auggagaaaagacgaagag

SEQ ID NO: 324 - RNA, 19 nt, Artificial
  Chemically Synthesized
ccaaagacagcaucugagc

SEQ ID NO: 325 - RNA, 19 nt, Artificial
  Chemically Synthesized
ucucuccuugguccuggaa

SEQ ID NO: 326 - RNA, 19 nt, Artificial
  Chemically Synthesized
ucguuuuuuacacgagauu

SEQ ID NO: 327 - RNA, 19 nt, Artificial
  Chemically Synthesized
acuuuuuguagagagagcu

SEQ ID NO: 328 - RNA, 19 nt, Artificial
  Chemically Synthesized
uuaagugguuacuuugugu

SEQ ID NO: 329 - RNA, 19 nt, Artificial
  Chemically Synthesized
aaacaggaacuugaauacu

SEQ ID NO: 330 - RNA, 19 nt, Artificial
  Chemically Synthesized
gaucaaugccaugaccuac

SEQ ID NO: 331 - RNA, 19 nt, Artificial
  Chemically Synthesized
uuauggagaaaagacgaag

SEQ ID NO: 332 - RNA, 19 nt, Artificial
  Chemically Synthesized
aacacgacaccggauaaac

SEQ ID NO: 333 - RNA, 19 nt, Artificial
  Chemically Synthesized
uggccaguuugcuuuccuc

SEQ ID NO: 334 - RNA, 19 nt, Artificial
  Chemically Synthesized
aacugcaugacccagauca

SEQ ID NO: 335 - RNA, 19 nt, Artificial
  Chemically Synthesized
ucugaagaaagauagcucg

SEQ ID NO: 336 - RNA, 19 nt, Artificial
  Chemically Synthesized
augcucugaagaaagauag

SEQ ID NO: 337 - RNA, 19 nt, Artificial
  Chemically Synthesized
cugagccagcugaaaacac

SEQ ID NO: 338 - RNA, 19 nt, Artificial
  Chemically Synthesized
accaaagacagcaucugag

SEQ ID NO: 339 - RNA, 19 nt, Artificial
  Chemically Synthesized
ugcugauaacagcggaauc

SEQ ID NO: 340 - RNA, 19 nt, Artificial
  Chemically Synthesized
ugugaugccaaagauguuu

SEQ ID NO: 341 - RNA, 19 nt, Artificial
  Chemically Synthesized
gacauucuggaaaugacag

SEQ ID NO: 342 - RNA, 19 nt, Artificial
  Chemically Synthesized
agacagcaucugagcacag

SEQ ID NO: 343 - RNA, 19 nt, Artificial
  Chemically Synthesized
gagaaaaauuccucguccc

SEQ ID NO: 344 - RNA, 19 nt, Artificial
  Chemically Synthesized
uucguuuuuuacacgagau

SEQ ID NO: 345 - RNA, 19 nt, Artificial
  Chemically Synthesized
cagaucaaugccaugaccu

SEQ ID NO: 346 - RNA, 19 nt, Artificial
  Chemically Synthesized
ugcaugacccagaucaaug

SEQ ID NO: 347 - RNA, 19 nt, Artificial
  Chemically Synthesized
acugaucaccaaguagcca

SEQ ID NO: 348 - RNA, 19 nt, Artificial
  Chemically Synthesized
acacgacaccggauaaacc

SEQ ID NO: 349 - RNA, 19 nt, Artificial
  Chemically Synthesized
uacuuuuuguagagagagc

SEQ ID NO: 350 - RNA, 19 nt, Artificial
  Chemically Synthesized
cugaagaaagauagcucgc

SEQ ID NO: 351 - RNA, 19 nt, Artificial
  Chemically Synthesized
agccagcugaaaacacuga

SEQ ID NO: 352 - RNA, 19 nt, Artificial
  Chemically Synthesized
aaagucaucaaagccuauu

SEQ ID NO: 353 - RNA, 19 nt, Artificial
  Chemically Synthesized
cugagcacagaaagucauc

SEQ ID NO: 354 - RNA, 19 nt, Artificial
  Chemically Synthesized
agucucaaguaaaagagac

SEQ ID NO: 355 - RNA, 19 nt, Artificial
  Chemically Synthesized
ugcucugaagaaagauagc

SEQ ID NO: 356 - RNA, 19 nt, Artificial
  Chemically Synthesized
uaaaauaucuuccuuuggg

SEQ ID NO: 357 - RNA, 19 nt, Artificial
  Chemically Synthesized
gugaugccaaagauguuug

SEQ ID NO: 358 - RNA, 19 nt, Artificial
  Chemically Synthesized
aauacugggagagaagagg

SEQ ID NO: 359 - RNA, 19 nt, Artificial
  Chemically Synthesized
aauaaaugaaagucugagc

SEQ ID NO: 360 - RNA, 19 nt, Artificial
  Chemically Synthesized
aaaccaaagacagcaucug

SEQ ID NO: 361 - RNA, 19 nt, Artificial
  Chemically Synthesized
aguuugcuuuccucauucc

SEQ ID NO: 362 - RNA, 19 nt, Artificial
  Chemically Synthesized
cuggaaaugacagugaagc

SEQ ID NO: 363 - RNA, 19 nt, Artificial
  Chemically Synthesized
cauuccaagcuggagaagg

SEQ ID NO: 364 - RNA, 19 nt, Artificial
  Chemically Synthesized
aacacugauuuuggaugcu

SEQ ID NO: 365 - RNA, 19 nt, Artificial
  Chemically Synthesized
uuuuuaugugaugccaaag

SEQ ID NO: 366 - RNA, 19 nt, Artificial
  Chemically Synthesized
aaagcucagaugacauuuc

SEQ ID NO: 367 - RNA, 19 nt, Artificial
  Chemically Synthesized
auucuggaaaugacaguga

SEQ ID NO: 368 - RNA, 19 nt, Artificial
  Chemically Synthesized
acagaaagucaucaaagcc

SEQ ID NO: 369 - RNA, 19 nt, Artificial
  Chemically Synthesized
augccagcugauauaaugg

SEQ ID NO: 370 - RNA, 19 nt, Artificial
  Chemically Synthesized
ucauauuggauugcgccuu

SEQ ID NO: 371 - RNA, 19 nt, Artificial
  Chemically Synthesized
guuugcuuuccucauuccc

SEQ ID NO: 372 - RNA, 19 nt, Artificial
  Chemically Synthesized
aagaaagauagcucgcggc

SEQ ID NO: 373 - RNA, 19 nt, Artificial
  Chemically Synthesized
auggagaaaaauuccucgu

SEQ ID NO: 374 - RNA, 19 nt, Artificial
  Chemically Synthesized
gucuaccucucuccuuggu

SEQ ID NO: 375 - RNA, 19 nt, Artificial
  Chemically Synthesized
aagauguuugaaaaugcuc

SEQ ID NO: 376 - RNA, 19 nt, Artificial
  Chemically Synthesized
uuuuuguagagagagcugu

SEQ ID NO: 377 - RNA, 19 nt, Artificial
  Chemically Synthesized
gaaaugacagugaagcacc

SEQ ID NO: 378 - RNA, 19 nt, Artificial
  Chemically Synthesized
ugcucuuaaaauaucuucc

SEQ ID NO: 379 - RNA, 19 nt, Artificial
  Chemically Synthesized
uauuaagugacugaccaug

SEQ ID NO: 380 - RNA, 19 nt, Artificial
  Chemically Synthesized
aaaacacugauuuuggaug

SEQ ID NO: 381 - RNA, 19 nt, Artificial
  Chemically Synthesized
ucaaugccaugaccuaccc

SEQ ID NO: 382 - RNA, 19 nt, Artificial
  Chemically Synthesized
acauucuggaaaugacagu

SEQ ID NO: 383 - RNA, 19 nt, Artificial
  Chemically Synthesized
ugaagaaagauagcucgcg

SEQ ID NO: 384 - RNA, 19 nt, Artificial
  Chemically Synthesized
uggagaaaaauuccucguc

SEQ ID NO: 385 - RNA, 19 nt, Artificial
  Chemically Synthesized
uuuuucgugaagaacucca

SEQ ID NO: 386 - RNA, 19 nt, Artificial
  Chemically Synthesized
uacugaucaccaaguagcc

SEQ ID NO: 387 - RNA, 19 nt, Artificial
  Chemically Synthesized
auuccaagcuggagaaggc

SEQ ID NO: 388 - RNA, 19 nt, Artificial
  Chemically Synthesized
caucugagcacagaaaguc

SEQ ID NO: 389 - RNA, 19 nt, Artificial
  Chemically Synthesized
aaagucucaaguaaaagag

SEQ ID NO: 390 - RNA, 19 nt, Artificial
  Chemically Synthesized
auauuggauugcgccuuug

SEQ ID NO: 391 - RNA, 19 nt, Artificial
  Chemically Synthesized
ucccuccggacucuaaaca

SEQ ID NO: 392 - RNA, 19 nt, Artificial
  Chemically Synthesized
caacugcaugacccagauc

SEQ ID NO: 393 - RNA, 19 nt, Artificial
  Chemically Synthesized
aaacacugauuuuggaugc

SEQ ID NO: 394 - RNA, 19 nt, Artificial
  Chemically Synthesized
aaagacagcaucugagcac

SEQ ID NO: 395 - RNA, 19 nt, Artificial
  Chemically Synthesized
aauggagaaaaauuccucg

SEQ ID NO: 396 - RNA, 19 nt, Artificial
  Chemically Synthesized
uucuuuuucgugaagaacu

SEQ ID NO: 397 - RNA, 19 nt, Artificial
  Chemically Synthesized
uuacuuuuuguagagagag

SEQ ID NO: 398 - RNA, 19 nt, Artificial
  Chemically Synthesized
acccagaucaaugccauga

SEQ ID NO: 399 - RNA, 19 nt, Artificial
  Chemically Synthesized
augacccagaucaaugcca

SEQ ID NO: 400 - RNA, 19 nt, Artificial
  Chemically Synthesized
cuucagcgagugcaugaac

SEQ ID NO: 401 - RNA, 19 nt, Artificial
  Chemically Synthesized
cauucuggaaaugacagug

SEQ ID NO: 402 - RNA, 19 nt, Artificial
  Chemically Synthesized
cacuugcucaguaguuuug

SEQ ID NO: 403 - RNA, 19 nt, Artificial
  Chemically Synthesized
auggccaguuugcuuuccu

SEQ ID NO: 404 - RNA, 19 nt, Artificial
  Chemically Synthesized
ugaaagucugagccagcug

SEQ ID NO: 405 - RNA, 19 nt, Artificial
  Chemically Synthesized
auuucguuuuuuacacgag

SEQ ID NO: 406 - RNA, 19 nt, Artificial
  Chemically Synthesized
uaagugguuacuuuguguu

SEQ ID NO: 407 - RNA, 19 nt, Artificial
  Chemically Synthesized
aauauaauaaacccucagc

SEQ ID NO: 408 - RNA, 19 nt, Artificial
  Chemically Synthesized
cuuuccucauucccaacgg

SEQ ID NO: 409 - RNA, 19 nt, Artificial
  Chemically Synthesized
cuacugaucaccaaguagc

SEQ ID NO: 410 - RNA, 19 nt, Artificial
  Chemically Synthesized
acauuucguuuuuuacacg

SEQ ID NO: 411 - RNA, 19 nt, Artificial
  Chemically Synthesized
guucauauuggauugcgcc

SEQ ID NO: 412 - RNA, 19 nt, Artificial
  Chemically Synthesized
uaagugacugaccaugcac

SEQ ID NO: 413 - RNA, 19 nt, Artificial
  Chemically Synthesized
auuaagugacugaccaugc

SEQ ID NO: 414 - RNA, 19 nt, Artificial
  Chemically Synthesized
cugaucaccaaguagccac

SEQ ID NO: 415 - RNA, 19 nt, Artificial
  Chemically Synthesized
uaauggagaaaaauuccuc

SEQ ID NO: 416 - RNA, 19 nt, Artificial
  Chemically Synthesized
uucccuccggacucuaaac

SEQ ID NO: 417 - RNA, 19 nt, Artificial
  Chemically Synthesized
gcuuuccucauucccaacg

SEQ ID NO: 418 - RNA, 19 nt, Artificial
  Chemically Synthesized
caugacccagaucaaugcc

SEQ ID NO: 419 - RNA, 19 nt, Artificial
  Chemically Synthesized
acacugauuuuggaugcuc

SEQ ID NO: 420 - RNA, 19 nt, Artificial
  Chemically Synthesized
auaaaccaaagacagcauc

SEQ ID NO: 421 - RNA, 19 nt, Artificial
  Chemically Synthesized
gcugauaacagcggaaucc

SEQ ID NO: 422 - RNA, 19 nt, Artificial
  Chemically Synthesized
uuaauaccgaggugcgcac

SEQ ID NO: 423 - RNA, 19 nt, Artificial
  Chemically Synthesized
cugauaacagcggaauccc

SEQ ID NO: 424 - RNA, 19 nt, Artificial
  Chemically Synthesized
uaaacccucagcacuugcu

SEQ ID NO: 425 - RNA, 19 nt, Artificial
  Chemically Synthesized
auuaagugguuacuuugug

SEQ ID NO: 426 - RNA, 19 nt, Artificial
  Chemically Synthesized
aacuugaauacugggagag

SEQ ID NO: 427 - RNA, 19 nt, Artificial
  Chemically Synthesized
aaacccucagcacuugcuc

SEQ ID NO: 428 - RNA, 19 nt, Artificial
  Chemically Synthesized
uaauaccgaggugcgcacu

SEQ ID NO: 429 - RNA, 19 nt, Artificial
  Chemically Synthesized
aagauagcucgcggcauuc

SEQ ID NO: 430 - RNA, 19 nt, Artificial
  Chemically Synthesized
ucucaaguaaaagagacac

SEQ ID NO: 431 - RNA, 19 nt, Artificial
  Chemically Synthesized
uucagcgagugcaugaacg

SEQ ID NO: 432 - RNA, 19 nt, Artificial
  Chemically Synthesized
auucuuuuucgugaagaac

SEQ ID NO: 433 - RNA, 19 nt, Artificial
  Chemically Synthesized
uucauauuggauugcgccu

SEQ ID NO: 434 - RNA, 19 nt, Artificial
  Chemically Synthesized
uuuccucauucccaacggg

SEQ ID NO: 435 - RNA, 19 nt, Artificial
  Chemically Synthesized
uaccucucuccuugguccu

SEQ ID NO: 436 - RNA, 19 nt, Artificial
  Chemically Synthesized
auaaaugaaagucugagcc

SEQ ID NO: 437 - RNA, 19 nt, Artificial
  Chemically Synthesized
cuuuuucgugaagaacucc

SEQ ID NO: 438 - RNA, 19 nt, Artificial
  Chemically Synthesized
auguucauauuggauugcg

SEQ ID NO: 439 - RNA, 19 nt, Artificial
  Chemically Synthesized
gauggccaguuugcuuucc

SEQ ID NO: 440 - RNA, 19 nt, Artificial
  Chemically Synthesized
aagguguuuggaggcuucc

SEQ ID NO: 441 - RNA, 19 nt, Artificial
  Chemically Synthesized
augacagugaagcaccucc

SEQ ID NO: 442 - RNA, 19 nt, Artificial
  Chemically Synthesized
uucuuuuuuaugugaugcc

SEQ ID NO: 443 - RNA, 19 nt, Artificial
  Chemically Synthesized
aucaaugccaugaccuacc

SEQ ID NO: 444 - RNA, 19 nt, Artificial
  Chemically Synthesized
ucuaccucucuccuugguc

SEQ ID NO: 445 - RNA, 19 nt, Artificial
  Chemically Synthesized
auaaacccucagcacuugc

SEQ ID NO: 446 - RNA, 19 nt, Artificial
  Chemically Synthesized
aaugacagugaagcaccuc

SEQ ID NO: 447 - RNA, 19 nt, Artificial
  Chemically Synthesized
uauguucauauuggauugc

SEQ ID NO: 448 - RNA, 19 nt, Artificial
  Chemically Synthesized
aacagcgcuacugaucacc

SEQ ID NO: 449 - RNA, 19 nt, Artificial
  Chemically Synthesized
uuuuauaauacaaaggcgc

SEQ ID NO: 450 - RNA, 19 nt, Artificial
  Chemically Synthesized
uuugugucucuuuuacuug

SEQ ID NO: 451 - RNA, 19 nt, Artificial
  Chemically Synthesized
uucaaguuccuguuuagag

SEQ ID NO: 452 - RNA, 19 nt, Artificial
  Chemically Synthesized
uuccgcuguuaucagcacc

SEQ ID NO: 453 - RNA, 19 nt, Artificial
  Chemically Synthesized
uuuucaaacaucuuuggca

SEQ ID NO: 454 - RNA, 19 nt, Artificial
  Chemically Synthesized
uucucucccaguauucaag

SEQ ID NO: 455 - RNA, 19 nt, Artificial
  Chemically Synthesized
uuguuugugucucuuuuac

SEQ ID NO: 456 - RNA, 19 nt, Artificial
  Chemically Synthesized
auuuuuggaguucuucacg

SEQ ID NO: 457 - RNA, 19 nt, Artificial
  Chemically Synthesized
ucucccaguauucaaguuc

SEQ ID NO: 458 - RNA, 19 nt, Artificial
  Chemically Synthesized
ugucauuuccagaaugucc

SEQ ID NO: 459 - RNA, 19 nt, Artificial
  Chemically Synthesized
ugcucuucgucuuuucucc

SEQ ID NO: 460 - RNA, 19 nt, Artificial
  Chemically Synthesized
uuucugugcucagaugcug

SEQ ID NO: 461 - RNA, 19 nt, Artificial
  Chemically Synthesized
uaggcuuugaugacuuucu

SEQ ID NO: 462 - RNA, 19 nt, Artificial
  Chemically Synthesized
uuugaugacuuucugugcu

SEQ ID NO: 463 - RNA, 19 nt, Artificial
  Chemically Synthesized
uuuagaguccggagggaag

SEQ ID NO: 464 - RNA, 19 nt, Artificial
  Chemically Synthesized
aaaaaaguccucuucucuc

SEQ ID NO: 465 - RNA, 19 nt, Artificial
  Chemically Synthesized
uuuuguggcuacuugguga

SEQ ID NO: 466 - RNA, 19 nt, Artificial
  Chemically Synthesized
ucuuuucuccauaauaggc

SEQ ID NO: 467 - RNA, 19 nt, Artificial
  Chemically Synthesized
uucuccagcuuggaaugcc

SEQ ID NO: 468 - RNA, 19 nt, Artificial
  Chemically Synthesized
uccaaaaucaguguuuuca

SEQ ID NO: 469 - RNA, 19 nt, Artificial
  Chemically Synthesized
uuuuuggaguucuucacga

SEQ ID NO: 470 - RNA, 19 nt, Artificial
  Chemically Synthesized
uuggcaucacauaaaaaag

SEQ ID NO: 471 - RNA, 19 nt, Artificial
  Chemically Synthesized
ucucucuacaaaaaguaac

SEQ ID NO: 472 - RNA, 19 nt, Artificial
  Chemically Synthesized
uuuucagcuggcucagacu

SEQ ID NO: 473 - RNA, 19 nt, Artificial
  Chemically Synthesized
ucuccauuauaucagcugg

SEQ ID NO: 474 - RNA, 19 nt, Artificial
  Chemically Synthesized
aaaaguccucuucucuccc

SEQ ID NO: 475 - RNA, 19 nt, Artificial
  Chemically Synthesized
uugaucugggucaugcagu

SEQ ID NO: 476 - RNA, 19 nt, Artificial
  Chemically Synthesized
uuuucuccauuauaucagc

SEQ ID NO: 477 - RNA, 19 nt, Artificial
  Chemically Synthesized
uugggaaugaggaaagcaa

SEQ ID NO: 478 - RNA, 19 nt, Artificial
  Chemically Synthesized
uucagagcauccaaaauca

SEQ ID NO: 479 - RNA, 19 nt, Artificial
  Chemically Synthesized
uugugucucuuuuacuuga

SEQ ID NO: 480 - RNA, 19 nt, Artificial
  Chemically Synthesized
aucuuucuucagagcaucc

SEQ ID NO: 481 - RNA, 19 nt, Artificial
  Chemically Synthesized
aucaguagcgcuguuccag

SEQ ID NO: 482 - RNA, 19 nt, Artificial
  Chemically Synthesized
ugcugucuuugguuuaucc

SEQ ID NO: 483 - RNA, 19 nt, Artificial
  Chemically Synthesized
uguuaucagcaccagcucc

SEQ ID NO: 484 - RNA, 19 nt, Artificial
  Chemically Synthesized
uucacaaaacuacugagca

SEQ ID NO: 485 - RNA, 19 nt, Artificial
  Chemically Synthesized
aucaaaaaaguccucuucu

SEQ ID NO: 486 - RNA, 19 nt, Artificial
  Chemically Synthesized
aaaaaguccucuucucucc

SEQ ID NO: 487 - RNA, 19 nt, Artificial
  Chemically Synthesized
uuucuucagagcauccaaa

SEQ ID NO: 488 - RNA, 19 nt, Artificial
  Chemically Synthesized
uguuugugucucuuuuacu

SEQ ID NO: 489 - RNA, 19 nt, Artificial
  Chemically Synthesized
uuuauaauacaaaggcgca

SEQ ID NO: 490 - RNA, 19 nt, Artificial
  Chemically Synthesized
augaggaaagcaaacuggc

SEQ ID NO: 491 - RNA, 19 nt, Artificial
  Chemically Synthesized
uucacugucauuuccagaa

SEQ ID NO: 492 - RNA, 19 nt, Artificial
  Chemically Synthesized
agagcauccaaaaucagug

SEQ ID NO: 493 - RNA, 19 nt, Artificial
  Chemically Synthesized
auggucagucacuuaauac

SEQ ID NO: 494 - RNA, 19 nt, Artificial
  Chemically Synthesized
cuucagagcauccaaaauc

SEQ ID NO: 495 - RNA, 19 nt, Artificial
  Chemically Synthesized
acuuucugugcucagaugc

SEQ ID NO: 496 - RNA, 19 nt, Artificial
  Chemically Synthesized
uucugugcucagaugcugu

SEQ ID NO: 497 - RNA, 19 nt, Artificial
  Chemically Synthesized
uuucuccauuauaucagcu

SEQ ID NO: 498 - RNA, 19 nt, Artificial
  Chemically Synthesized
uauuuuuggaguucuucac

SEQ ID NO: 499 - RNA, 19 nt, Artificial
  Chemically Synthesized
uuuggaguucuucacgaaa

SEQ ID NO: 500 - RNA, 19 nt, Artificial
  Chemically Synthesized
uaggucauggcauugaucu

SEQ ID NO: 501 - RNA, 19 nt, Artificial
  Chemically Synthesized
uuggaaugccgcgagcuau

SEQ ID NO: 502 - RNA, 19 nt, Artificial
  Chemically Synthesized
uacuuggugaucaguagcg

SEQ ID NO: 503 - RNA, 19 nt, Artificial
  Chemically Synthesized
ucagcuggcucagacuuuc

SEQ ID NO: 504 - RNA, 19 nt, Artificial
  Chemically Synthesized
uauuuuguggcuacuuggu

SEQ ID NO: 505 - RNA, 19 nt, Artificial
  Chemically Synthesized
ugcuucacugucauuucca

SEQ ID NO: 506 - RNA, 19 nt, Artificial
  Chemically Synthesized
uucagcuggcucagacuuu

SEQ ID NO: 507 - RNA, 19 nt, Artificial
  Chemically Synthesized
uucuugcucuucgucuuuu

SEQ ID NO: 508 - RNA, 19 nt, Artificial
  Chemically Synthesized
ucaaaaaaguccucuucuc

SEQ ID NO: 509 - RNA, 19 nt, Artificial
  Chemically Synthesized
uccgcuguuaucagcacca

SEQ ID NO: 510 - RNA, 19 nt, Artificial
  Chemically Synthesized
auacaaauauagugcaugg

SEQ ID NO: 511 - RNA, 19 nt, Artificial
  Chemically Synthesized
aaaaucaguguuuucagcu

SEQ ID NO: 512 - RNA, 19 nt, Artificial
  Chemically Synthesized
ucaaacaucuuuggcauca

SEQ ID NO: 513 - RNA, 19 nt, Artificial
  Chemically Synthesized
uacagcucucucuacaaaa

SEQ ID NO: 514 - RNA, 19 nt, Artificial
  Chemically Synthesized
augccgcgagcuaucuuuc

SEQ ID NO: 515 - RNA, 19 nt, Artificial
  Chemically Synthesized
ucagucacuuaauacagcu

SEQ ID NO: 516 - RNA, 19 nt, Artificial
  Chemically Synthesized
gucauuuccagaauguccg

SEQ ID NO: 517 - RNA, 19 nt, Artificial
  Chemically Synthesized
uaauaggcuuugaugacuu

SEQ ID NO: 518 - RNA, 19 nt, Artificial
  Chemically Synthesized
uugagacuuucacaaaacu

SEQ ID NO: 519 - RNA, 19 nt, Artificial
  Chemically Synthesized
uuucaaacaucuuuggcau

SEQ ID NO: 520 - RNA, 19 nt, Artificial
  Chemically Synthesized
uggucagucacuuaauaca

SEQ ID NO: 521 - RNA, 19 nt, Artificial
  Chemically Synthesized
aaucaaaaaaguccucuuc

SEQ ID NO: 522 - RNA, 19 nt, Artificial
  Chemically Synthesized
uuccuguuuagaguccgga

SEQ ID NO: 523 - RNA, 19 nt, Artificial
  Chemically Synthesized
auuuuguggcuacuuggug

SEQ ID NO: 524 - RNA, 19 nt, Artificial
  Chemically Synthesized
auugaucugggucaugcag

SEQ ID NO: 525 - RNA, 19 nt, Artificial
  Chemically Synthesized
ucuucgucuuuucuccaua

SEQ ID NO: 526 - RNA, 19 nt, Artificial
  Chemically Synthesized
ucgucuuuucuccauaaua

SEQ ID NO: 527 - RNA, 19 nt, Artificial
  Chemically Synthesized
uacaaaggcgcaauccaau

SEQ ID NO: 528 - RNA, 19 nt, Artificial
  Chemically Synthesized
cacuuaaucaaaaaagucc

SEQ ID NO: 529 - RNA, 19 nt, Artificial
  Chemically Synthesized
uuagaguccggagggaaga

SEQ ID NO: 530 - RNA, 19 nt, Artificial
  Chemically Synthesized
cuuuucuccauaauaggcu

SEQ ID NO: 531 - RNA, 19 nt, Artificial
  Chemically Synthesized
agucacuuaauacagcucu

SEQ ID NO: 532 - RNA, 19 nt, Artificial
  Chemically Synthesized
uucuucagagcauccaaaa

SEQ ID NO: 533 - RNA, 19 nt, Artificial
  Chemically Synthesized
uuucagcuggcucagacuu

SEQ ID NO: 534 - RNA, 19 nt, Artificial
  Chemically Synthesized
uugguuuauccggugucgu

SEQ ID NO: 535 - RNA, 19 nt, Artificial
  Chemically Synthesized
auuauaucagcuggcauuu

SEQ ID NO: 536 - RNA, 19 nt, Artificial
  Chemically Synthesized
uauaauacaaaggcgcaau

SEQ ID NO: 537 - RNA, 19 nt, Artificial
  Chemically Synthesized
ucuucucucccaguauuca

SEQ ID NO: 538 - RNA, 19 nt, Artificial
  Chemically Synthesized
ucucucccaguauucaagu

SEQ ID NO: 539 - RNA, 19 nt, Artificial
  Chemically Synthesized
uuucuccauaauaggcuuu

SEQ ID NO: 540 - RNA, 19 nt, Artificial
  Chemically Synthesized
ugagacuuucacaaaacua

SEQ ID NO: 541 - RNA, 19 nt, Artificial
  Chemically Synthesized
aagagcauuuucaaacauc

SEQ ID NO: 542 - RNA, 19 nt, Artificial
  Chemically Synthesized
aaaaacacaaaguaaccac

SEQ ID NO: 543 - RNA, 19 nt, Artificial
  Chemically Synthesized
aaguccucuucucucccag

SEQ ID NO: 544 - RNA, 19 nt, Artificial
  Chemically Synthesized
uauuaacgcccucgcacgu

SEQ ID NO: 545 - RNA, 19 nt, Artificial
  Chemically Synthesized
auaauaggcuuugaugacu

SEQ ID NO: 546 - RNA, 19 nt, Artificial
  Chemically Synthesized
uuuccagaauguccgccuu

SEQ ID NO: 547 - RNA, 19 nt, Artificial
  Chemically Synthesized
uuuucuccauaauaggcuu

SEQ ID NO: 548 - RNA, 19 nt, Artificial
  Chemically Synthesized
aaacgaaaugucaucugag

SEQ ID NO: 549 - RNA, 19 nt, Artificial
  Chemically Synthesized
auuuucaaacaucuuuggc

SEQ ID NO: 550 - RNA, 19 nt, Artificial
  Chemically Synthesized
uacugagcaagugcugagg

SEQ ID NO: 551 - RNA, 19 nt, Artificial
  Chemically Synthesized
cuuaauacagcucucucua

SEQ ID NO: 552 - RNA, 19 nt, Artificial
  Chemically Synthesized
auucaaguuccuguuuaga

SEQ ID NO: 553 - RNA, 19 nt, Artificial
  Chemically Synthesized
aguuccuguuuagaguccg

SEQ ID NO: 554 - RNA, 19 nt, Artificial
  Chemically Synthesized
uguuccaggaccaaggaga

SEQ ID NO: 555 - RNA, 19 nt, Artificial
  Chemically Synthesized
gcauuuucaaacaucuuug

SEQ ID NO: 556 - RNA, 19 nt, Artificial
  Chemically Synthesized
ucucguguaaaaaacgaaa

SEQ ID NO: 557 - RNA, 19 nt, Artificial
  Chemically Synthesized
uagugcauggucagucacu

SEQ ID NO: 558 - RNA, 19 nt, Artificial
  Chemically Synthesized
cucccaguauucaaguucc

SEQ ID NO: 559 - RNA, 19 nt, Artificial
  Chemically Synthesized
uucaugcacucgcugaagc

SEQ ID NO: 560 - RNA, 19 nt, Artificial
  Chemically Synthesized
ucauuuccagaauguccgc

SEQ ID NO: 561 - RNA, 19 nt, Artificial
  Chemically Synthesized
auccaaaaucaguguuuuc

SEQ ID NO: 562 - RNA, 19 nt, Artificial
  Chemically Synthesized
auucuugcucuucgucuuu

SEQ ID NO: 563 - RNA, 19 nt, Artificial
  Chemically Synthesized
aaaaacgaaaugucaucug

SEQ ID NO: 564 - RNA, 19 nt, Artificial
  Chemically Synthesized
acgaaaugucaucugagcu

SEQ ID NO: 565 - RNA, 19 nt, Artificial
  Chemically Synthesized
cucuucucucccaguauuc

SEQ ID NO: 566 - RNA, 19 nt, Artificial
  Chemically Synthesized
ccaguauucaaguuccugu

SEQ ID NO: 567 - RNA, 19 nt, Artificial
  Chemically Synthesized
ugaggaaagcaaacuggcc

SEQ ID NO: 568 - RNA, 19 nt, Artificial
  Chemically Synthesized
uguggcuacuuggugauca

SEQ ID NO: 569 - RNA, 19 nt, Artificial
  Chemically Synthesized
ugugcucagaugcugucuu

SEQ ID NO: 570 - RNA, 19 nt, Artificial
  Chemically Synthesized
ugucuuugguuuauccggu

SEQ ID NO: 571 - RNA, 19 nt, Artificial
  Chemically Synthesized
cuccauuauaucagcuggc

SEQ ID NO: 572 - RNA, 19 nt, Artificial
  Chemically Synthesized
uuauaucagcuggcauuuu

SEQ ID NO: 573 - RNA, 19 nt, Artificial
  Chemically Synthesized
ucucuuuuacuugagacuu

SEQ ID NO: 574 - RNA, 19 nt, Artificial
  Chemically Synthesized
uggaaggugacacugcguu

SEQ ID NO: 575 - RNA, 19 nt, Artificial
  Chemically Synthesized
cauggcauugaucuggguc

SEQ ID NO: 576 - RNA, 19 nt, Artificial
  Chemically Synthesized
ucaccucguucaugcacuc

SEQ ID NO: 577 - RNA, 19 nt, Artificial
  Chemically Synthesized
uccagaauguccgccuucu

SEQ ID NO: 578 - RNA, 19 nt, Artificial
  Chemically Synthesized
ugccgcgagcuaucuuucu

SEQ ID NO: 579 - RNA, 19 nt, Artificial
  Chemically Synthesized
ucugugcucagaugcuguc

SEQ ID NO: 580 - RNA, 19 nt, Artificial
  Chemically Synthesized
cugucuuugguuuauccgg

SEQ ID NO: 581 - RNA, 19 nt, Artificial
  Chemically Synthesized
ugguuuauccggugucgug

SEQ ID NO: 582 - RNA, 19 nt, Artificial
  Chemically Synthesized
aaaacuacugagcaagugc

SEQ ID NO: 583 - RNA, 19 nt, Artificial
  Chemically Synthesized
agagcauuuucaaacaucu

SEQ ID NO: 584 - RNA, 19 nt, Artificial
  Chemically Synthesized
augucaucugagcuuuuau

SEQ ID NO: 585 - RNA, 19 nt, Artificial
  Chemically Synthesized
cucuacaaaaaguaacuuc

SEQ ID NO: 586 - RNA, 19 nt, Artificial
  Chemically Synthesized
uccuguuuagaguccggag

SEQ ID NO: 587 - RNA, 19 nt, Artificial
  Chemically Synthesized
acuuggugaucaguagcgc

SEQ ID NO: 588 - RNA, 19 nt, Artificial
  Chemically Synthesized
aaucaguguuuucagcugg

SEQ ID NO: 589 - RNA, 19 nt, Artificial
  Chemically Synthesized
uucgucuuuucuccauaau

SEQ ID NO: 590 - RNA, 19 nt, Artificial
  Chemically Synthesized
ugcucagaugcugucuuug

SEQ ID NO: 591 - RNA, 19 nt, Artificial
  Chemically Synthesized
ugucucuuuuacuugagac

SEQ ID NO: 592 - RNA, 19 nt, Artificial
  Chemically Synthesized
acuuucacaaaacuacuga

SEQ ID NO: 593 - RNA, 19 nt, Artificial
  Chemically Synthesized
auagugcauggucagucac

SEQ ID NO: 594 - RNA, 19 nt, Artificial
  Chemically Synthesized
auggcauugaucuggguca

SEQ ID NO: 595 - RNA, 19 nt, Artificial
  Chemically Synthesized
ccgcgagcuaucuuucuuc

SEQ ID NO: 596 - RNA, 19 nt, Artificial
  Chemically Synthesized
ucuuugguuuauccggugu

SEQ ID NO: 597 - RNA, 19 nt, Artificial
  Chemically Synthesized
uuggaguucuucacgaaaa

SEQ ID NO: 598 - RNA, 19 nt, Artificial
  Chemically Synthesized
guuugugucucuuuuacuu

SEQ ID NO: 599 - RNA, 19 nt, Artificial
  Chemically Synthesized
cuuuuauaauacaaaggcg

SEQ ID NO: 600 - RNA, 19 nt, Artificial
  Chemically Synthesized
ugcugaggguuuauuauau

SEQ ID NO: 601 - RNA, 19 nt, Artificial
  Chemically Synthesized
uccucuucucucccaguau

SEQ ID NO: 602 - RNA, 19 nt, Artificial
  Chemically Synthesized
cauuuccagaauguccgcc

SEQ ID NO: 603 - RNA, 19 nt, Artificial
  Chemically Synthesized
agaauguccgccuucucca

SEQ ID NO: 604 - RNA, 19 nt, Artificial
  Chemically Synthesized
agacuuucacaaaacuacu

SEQ ID NO: 605 - RNA, 19 nt, Artificial
  Chemically Synthesized
uucaaacaucuuuggcauc

SEQ ID NO: 606 - RNA, 19 nt, Artificial
  Chemically Synthesized
aacaucuuuggcaucacau

SEQ ID NO: 607 - RNA, 19 nt, Artificial
  Chemically Synthesized
auacaaaggcgcaauccaa

SEQ ID NO: 608 - RNA, 19 nt, Artificial
  Chemically Synthesized
ucguucaugcacucgcuga

SEQ ID NO: 609 - RNA, 19 nt, Artificial
  Chemically Synthesized
gucuuuucuccauaauagg

SEQ ID NO: 610 - RNA, 19 nt, Artificial
  Chemically Synthesized
ugucguguugacacuggcu

SEQ ID NO: 611 - RNA, 19 nt, Artificial
  Chemically Synthesized
gagacuuucacaaaacuac

SEQ ID NO: 612 - RNA, 19 nt, Artificial
  Chemically Synthesized
aagccuccaaacaccuuag

SEQ ID NO: 613 - RNA, 19 nt, Artificial
  Chemically Synthesized
gucaccucguucaugcacu

SEQ ID NO: 614 - RNA, 19 nt, Artificial
  Chemically Synthesized
aggugcuucacugucauuu

SEQ ID NO: 615 - RNA, 19 nt, Artificial
  Chemically Synthesized
cuugcucuucgucuuuucu

SEQ ID NO: 616 - RNA, 19 nt, Artificial
  Chemically Synthesized
uuuuggaguucuucacgaa

SEQ ID NO: 617 - RNA, 19 nt, Artificial
  Chemically Synthesized
uggcaucacauaaaaaaga

SEQ ID NO: 618 - RNA, 19 nt, Artificial
  Chemically Synthesized
aaauauagugcauggucag

SEQ ID NO: 619 - RNA, 19 nt, Artificial
  Chemically Synthesized
aaaacacaaaguaaccacu

SEQ ID NO: 620 - RNA, 19 nt, Artificial
  Chemically Synthesized
caaaaaaguccucuucucu

SEQ ID NO: 621 - RNA, 19 nt, Artificial
  Chemically Synthesized
uggaagccuccaaacaccu

SEQ ID NO: 622 - RNA, 19 nt, Artificial
  Chemically Synthesized
aguguuuucagcuggcuca

SEQ ID NO: 623 - RNA, 19 nt, Artificial
  Chemically Synthesized
aggcuuugaugacuuucug

SEQ ID NO: 624 - RNA, 19 nt, Artificial
  Chemically Synthesized
aggaagauauuuuaagagc

SEQ ID NO: 625 - RNA, 19 nt, Artificial
  Chemically Synthesized
ugcgcaccucgguauuaac

SEQ ID NO: 626 - RNA, 19 nt, Artificial
  Chemically Synthesized
ucagagcauccaaaaucag

SEQ ID NO: 627 - RNA, 19 nt, Artificial
  Chemically Synthesized
guuuucagcuggcucagac

SEQ ID NO: 628 - RNA, 19 nt, Artificial
  Chemically Synthesized
uccauuauaucagcuggca

SEQ ID NO: 629 - RNA, 19 nt, Artificial
  Chemically Synthesized
aaacacaaaguaaccacuu

SEQ ID NO: 630 - RNA, 19 nt, Artificial
  Chemically Synthesized
cccaguauucaaguuccug

SEQ ID NO: 631 - RNA, 19 nt, Artificial
  Chemically Synthesized
aaguuccuguuuagagucc

SEQ ID NO: 632 - RNA, 19 nt, Artificial
  Chemically Synthesized
uuuguggcuacuuggugau

SEQ ID NO: 633 - RNA, 19 nt, Artificial
  Chemically Synthesized
uuguggcuacuuggugauc

SEQ ID NO: 634 - RNA, 19 nt, Artificial
  Chemically Synthesized
cuggcucagacuuucauuu

SEQ ID NO: 635 - RNA, 19 nt, Artificial
  Chemically Synthesized
cucagacuuucauuuauuc

SEQ ID NO: 636 - RNA, 19 nt, Artificial
  Chemically Synthesized
cgucuuuucuccauaauag

SEQ ID NO: 637 - RNA, 19 nt, Artificial
  Chemically Synthesized
ugacuuucugugcucagau

SEQ ID NO: 638 - RNA, 19 nt, Artificial
  Chemically Synthesized
cuugagacuuucacaaaac

SEQ ID NO: 639 - RNA, 19 nt, Artificial
  Chemically Synthesized
ucguguaaaaaacgaaaug

SEQ ID NO: 640 - RNA, 19 nt, Artificial
  Chemically Synthesized
ucccaguauucaaguuccu

SEQ ID NO: 641 - RNA, 19 nt, Artificial
  Chemically Synthesized
guuccuguuuagaguccgg

SEQ ID NO: 642 - RNA, 19 nt, Artificial
  Chemically Synthesized
ugggaaugaggaaagcaaa

SEQ ID NO: 643 - RNA, 19 nt, Artificial
  Chemically Synthesized
gugcuucacugucauuucc

SEQ ID NO: 644 - RNA, 19 nt, Artificial
  Chemically Synthesized
guguaaaaaacgaaauguc

SEQ ID NO: 645 - RNA, 19 nt, Artificial
  Chemically Synthesized
ucuucagagcauccaaaau

SEQ ID NO: 646 - RNA, 19 nt, Artificial
  Chemically Synthesized
uggcucagacuuucauuua

SEQ ID NO: 647 - RNA, 19 nt, Artificial
  Chemically Synthesized
auccggugucguguugaca

SEQ ID NO: 648 - RNA, 19 nt, Artificial
  Chemically Synthesized
cacaaaacuacugagcaag

SEQ ID NO: 649 - RNA, 19 nt, Artificial
  Chemically Synthesized
ucuuuggcaucacauaaaa

SEQ ID NO: 650 - RNA, 19 nt, Artificial
  Chemically Synthesized
aaaucucguguaaaaaacg

SEQ ID NO: 651 - RNA, 19 nt, Artificial
  Chemically Synthesized
gcgcaauccaauaugaaca

SEQ ID NO: 652 - RNA, 19 nt, Artificial
  Chemically Synthesized
aauauagugcauggucagu

SEQ ID NO: 653 - RNA, 19 nt, Artificial
  Chemically Synthesized
cuucucucccaguauucaa

SEQ ID NO: 654 - RNA, 19 nt, Artificial
  Chemically Synthesized
ugugucucuuuuacuugag

SEQ ID NO: 655 - RNA, 19 nt, Artificial
  Chemically Synthesized
aauacagcucucucuacaa

SEQ ID NO: 656 - RNA, 19 nt, Artificial
  Chemically Synthesized
cucucuacaaaaaguaacu

SEQ ID NO: 657 - RNA, 19 nt, Artificial
  Chemically Synthesized
caaaguaaccacuuaauca

SEQ ID NO: 658 - RNA, 19 nt, Artificial
  Chemically Synthesized
cuuaaucaaaaaaguccuc

SEQ ID NO: 659 - RNA, 19 nt, Artificial
  Chemically Synthesized
aucaguguuuucagcuggc

SEQ ID NO: 660 - RNA, 19 nt, Artificial
  Chemically Synthesized
acuacugagcaagugcuga

SEQ ID NO: 661 - RNA, 19 nt, Artificial
  Chemically Synthesized
acaaaguaaccacuuaauc

SEQ ID NO: 662 - RNA, 19 nt, Artificial
  Chemically Synthesized
gaagccuccaaacaccuua

SEQ ID NO: 663 - RNA, 19 nt, Artificial
  Chemically Synthesized
cuacuuggugaucaguagc

SEQ ID NO: 664 - RNA, 19 nt, Artificial
  Chemically Synthesized
cagagcauccaaaaucagu

SEQ ID NO: 665 - RNA, 19 nt, Artificial
  Chemically Synthesized
ccaaaaucaguguuuucag

SEQ ID NO: 666 - RNA, 19 nt, Artificial
  Chemically Synthesized
auuccgcuguuaucagcac

SEQ ID NO: 667 - RNA, 19 nt, Artificial
  Chemically Synthesized
caucuuuggcaucacauaa

SEQ ID NO: 668 - RNA, 19 nt, Artificial
  Chemically Synthesized
aauacaaaggcgcaaucca

SEQ ID NO: 669 - RNA, 19 nt, Artificial
  Chemically Synthesized
gucagucacuuaauacagc

SEQ ID NO: 670 - RNA, 19 nt, Artificial
  Chemically Synthesized
aguccucuucucucccagu

SEQ ID NO: 671 - RNA, 19 nt, Artificial
  Chemically Synthesized
gcuguuaucagcaccagcu

SEQ ID NO: 672 - RNA, 19 nt, Artificial
  Chemically Synthesized
ucuccauaauaggcuuuga

SEQ ID NO: 673 - RNA, 19 nt, Artificial
  Chemically Synthesized
gcugucuuugguuuauccg

SEQ ID NO: 674 - RNA, 19 nt, Artificial
  Chemically Synthesized
gaguucuucacgaaaaaga

SEQ ID NO: 675 - RNA, 19 nt, Artificial
  Chemically Synthesized
cuuuuacuugagacuuuca

SEQ ID NO: 676 - RNA, 19 nt, Artificial
  Chemically Synthesized
acuugagacuuucacaaaa

SEQ ID NO: 677 - RNA, 19 nt, Artificial
  Chemically Synthesized
cuuucacaaaacuacugag

SEQ ID NO: 678 - RNA, 19 nt, Artificial
  Chemically Synthesized
caaguuccuguuuagaguc

SEQ ID NO: 679 - RNA, 19 nt, Artificial
  Chemically Synthesized
cuuucuucagagcauccaa

SEQ ID NO: 680 - RNA, 19 nt, Artificial
  Chemically Synthesized
acaaaggcgcaauccaaua

SEQ ID NO: 681 - RNA, 19 nt, Artificial
  Chemically Synthesized
gucacuuaauacagcucuc

SEQ ID NO: 682 - RNA, 19 nt, Artificial
  Chemically Synthesized
cuucacugucauuuccaga

SEQ ID NO: 683 - RNA, 19 nt, Artificial
  Chemically Synthesized
cuuucugugcucagaugcu

SEQ ID NO: 684 - RNA, 19 nt, Artificial
  Chemically Synthesized
cauuuucaaacaucuuugg

SEQ ID NO: 685 - RNA, 19 nt, Artificial
  Chemically Synthesized
aaaacgaaaugucaucuga

SEQ ID NO: 686 - RNA, 19 nt, Artificial
  Chemically Synthesized
uggugaucaguagcgcugu

SEQ ID NO: 687 - RNA, 19 nt, Artificial
  Chemically Synthesized
augacuuucugugcucaga

SEQ ID NO: 688 - RNA, 19 nt, Artificial
  Chemically Synthesized
aaacuacugagcaagugcu

SEQ ID NO: 689 - RNA, 19 nt, Artificial
  Chemically Synthesized
aacuacugagcaagugcug

SEQ ID NO: 690 - RNA, 19 nt, Artificial
  Chemically Synthesized
agugcugaggguuuauuau

SEQ ID NO: 691 - RNA, 19 nt, Artificial
  Chemically Synthesized
accuggaagccuccaaaca

SEQ ID NO: 692 - RNA, 19 nt, Artificial
  Chemically Synthesized
aaaucaguguuuucagcug

SEQ ID NO: 693 - RNA, 19 nt, Artificial
  Chemically Synthesized
ccauaauaggcuuugauga

SEQ ID NO: 694 - RNA, 19 nt, Artificial
  Chemically Synthesized
acaaaacuacugagcaagu

SEQ ID NO: 695 - RNA, 19 nt, Artificial
  Chemically Synthesized
ggucagucacuuaauacag

SEQ ID NO: 696 - RNA, 19 nt, Artificial
  Chemically Synthesized
auacagcucucucuacaaa

SEQ ID NO: 697 - RNA, 19 nt, Artificial
  Chemically Synthesized
cagcucucucuacaaaaag

SEQ ID NO: 698 - RNA, 19 nt, Artificial
  Chemically Synthesized
guccucuucucucccagua

SEQ ID NO: 699 - RNA, 19 nt, Artificial
  Chemically Synthesized
ggucauggcauugaucugg

SEQ ID NO: 700 - RNA, 19 nt, Artificial
  Chemically Synthesized
gcauugaucugggucaugc

SEQ ID NO: 701 - RNA, 19 nt, Artificial
  Chemically Synthesized
gagcuaucuuucuucagag

SEQ ID NO: 702 - RNA, 19 nt, Artificial
  Chemically Synthesized
caaaaucaguguuuucagc

SEQ ID NO: 703 - RNA, 19 nt, Artificial
  Chemically Synthesized
gucuuugguuuauccggug

SEQ ID NO: 704 - RNA, 19 nt, Artificial
  Chemically Synthesized
gacuuucacaaaacuacug

SEQ ID NO: 705 - RNA, 19 nt, Artificial
  Chemically Synthesized
gaaaucucguguaaaaaac

SEQ ID NO: 706 - RNA, 19 nt, Artificial
  Chemically Synthesized
ugagcaagugcugaggguu

SEQ ID NO: 707 - RNA, 19 nt, Artificial
  Chemically Synthesized
aaaugucaucugagcuuuu

SEQ ID NO: 708 - RNA, 19 nt, Artificial
  Chemically Synthesized
gucaucugagcuuuuauaa

SEQ ID NO: 709 - RNA, 19 nt, Artificial
  Chemically Synthesized
guugggaaugaggaaagca

SEQ ID NO: 710 - RNA, 19 nt, Artificial
  Chemically Synthesized
gaaagcaaacuggccaucg

SEQ ID NO: 711 - RNA, 19 nt, Artificial
  Chemically Synthesized
gucauggcauugaucuggg

SEQ ID NO: 712 - RNA, 19 nt, Artificial
  Chemically Synthesized
agcuaucuuucuucagagc

SEQ ID NO: 713 - RNA, 19 nt, Artificial
  Chemically Synthesized
cuuggugaucaguagcgcu

SEQ ID NO: 714 - RNA, 19 nt, Artificial
  Chemically Synthesized
agcuggcucagacuuucau

SEQ ID NO: 715 - RNA, 19 nt, Artificial
  Chemically Synthesized
cuccauaauaggcuuugau

SEQ ID NO: 716 - RNA, 19 nt, Artificial
  Chemically Synthesized
ugaugacuuucugugcuca

SEQ ID NO: 717 - RNA, 19 nt, Artificial
  Chemically Synthesized
cuacugagcaagugcugag

SEQ ID NO: 718 - RNA, 19 nt, Artificial
  Chemically Synthesized
gugcugaggguuuauuaua

SEQ ID NO: 719 - RNA, 19 nt, Artificial
  Chemically Synthesized
ccacuuaaucaaaaaaguc

SEQ ID NO: 720 - RNA, 19 nt, Artificial
  Chemically Synthesized
agccuccaaacaccuuagc

SEQ ID NO: 721 - RNA, 19 nt, Artificial
  Chemically Synthesized
accucgguauuaacgcccu

SEQ ID NO: 722 - RNA, 19 nt, Artificial
  Chemically Synthesized
acacuugggucugugcuca

SEQ ID NO: 723 - RNA, 19 nt, Artificial
  Chemically Synthesized
cauaauaggcuuugaugac

SEQ ID NO: 724 - RNA, 19 nt, Artificial
  Chemically Synthesized
agaugcugucuuugguuua

SEQ ID NO: 725 - RNA, 19 nt, Artificial
  Chemically Synthesized
ggacgaggaauuuuucucc

SEQ ID NO: 726 - RNA, 19 nt, Artificial
  Chemically Synthesized
ucacaaaacuacugagcaa

SEQ ID NO: 727 - RNA, 19 nt, Artificial
  Chemically Synthesized
cagucacuuaauacagcuc

SEQ ID NO: 728 - RNA, 19 nt, Artificial
  Chemically Synthesized
cuucuccagcuuggaaugc

SEQ ID NO: 729 - RNA, 19 nt, Artificial
  Chemically Synthesized
uguuuucagcuggcucaga

SEQ ID NO: 730 - RNA, 19 nt, Artificial
  Chemically Synthesized
gcuuuuauaauacaaaggc

SEQ ID NO: 731 - RNA, 19 nt, Artificial
  Chemically Synthesized
agugcauggucagucacuu

SEQ ID NO: 732 - RNA, 19 nt, Artificial
  Chemically Synthesized
caguguuuucagcuggcuc

SEQ ID NO: 733 - RNA, 19 nt, Artificial
  Chemically Synthesized
gcuggcucagacuuucauu

SEQ ID NO: 734 - RNA, 19 nt, Artificial
  Chemically Synthesized
gcucuucgucuuuucucca

SEQ ID NO: 735 - RNA, 19 nt, Artificial
  Chemically Synthesized
cucuucgucuuuucuccau

SEQ ID NO: 736 - RNA, 19 nt, Artificial
  Chemically Synthesized
gcucagaugcugucuuugg

SEQ ID NO: 737 - RNA, 19 nt, Artificial
  Chemically Synthesized
uuccaggaccaaggagaga

SEQ ID NO: 738 - RNA, 19 nt, Artificial
  Chemically Synthesized
aaucucguguaaaaaacga

SEQ ID NO: 739 - RNA, 19 nt, Artificial
  Chemically Synthesized
agcucucucuacaaaaagu

SEQ ID NO: 740 - RNA, 19 nt, Artificial
  Chemically Synthesized
acacaaaguaaccacuuaa

SEQ ID NO: 741 - RNA, 19 nt, Artificial
  Chemically Synthesized
aguauucaaguuccuguuu

SEQ ID NO: 742 - RNA, 19 nt, Artificial
  Chemically Synthesized
guaggucauggcauugauc

SEQ ID NO: 743 - RNA, 19 nt, Artificial
  Chemically Synthesized
cuucgucuuuucuccauaa

SEQ ID NO: 744 - RNA, 19 nt, Artificial
  Chemically Synthesized
guuuauccggugucguguu

SEQ ID NO: 745 - RNA, 19 nt, Artificial
  Chemically Synthesized
gaggaaagcaaacuggcca

SEQ ID NO: 746 - RNA, 19 nt, Artificial
  Chemically Synthesized
ugaucugggucaugcaguu

SEQ ID NO: 747 - RNA, 19 nt, Artificial
  Chemically Synthesized
cgagcuaucuuucuucaga

SEQ ID NO: 748 - RNA, 19 nt, Artificial
  Chemically Synthesized
cuaucuuucuucagagcau

SEQ ID NO: 749 - RNA, 19 nt, Artificial
  Chemically Synthesized
guguuuucagcuggcucag

SEQ ID NO: 750 - RNA, 19 nt, Artificial
  Chemically Synthesized
cucagaugcugucuuuggu

SEQ ID NO: 751 - RNA, 19 nt, Artificial
  Chemically Synthesized
gauuccgcuguuaucagca

SEQ ID NO: 752 - RNA, 19 nt, Artificial
  Chemically Synthesized
aaacaucuuuggcaucaca

SEQ ID NO: 753 - RNA, 19 nt, Artificial
  Chemically Synthesized
cugucauuuccagaauguc

SEQ ID NO: 754 - RNA, 19 nt, Artificial
  Chemically Synthesized
cugugcucagaugcugucu

SEQ ID NO: 755 - RNA, 19 nt, Artificial
  Chemically Synthesized
gggacgaggaauuuuucuc

SEQ ID NO: 756 - RNA, 19 nt, Artificial
  Chemically Synthesized
aucucguguaaaaaacgaa

SEQ ID NO: 757 - RNA, 19 nt, Artificial
  Chemically Synthesized
aggucauggcauugaucug

SEQ ID NO: 758 - RNA, 19 nt, Artificial
  Chemically Synthesized
cauugaucugggucaugca

SEQ ID NO: 759 - RNA, 19 nt, Artificial
  Chemically Synthesized
uggcuacuuggugaucagu

SEQ ID NO: 760 - RNA, 19 nt, Artificial
  Chemically Synthesized
gguuuauccggugucgugu

SEQ ID NO: 761 - RNA, 19 nt, Artificial
  Chemically Synthesized
gcucucucuacaaaaagua

SEQ ID NO: 762 - RNA, 19 nt, Artificial
  Chemically Synthesized
gcgagcuaucuuucuucag

SEQ ID NO: 763 - RNA, 19 nt, Artificial
  Chemically Synthesized
ucaguguuuucagcuggcu

SEQ ID NO: 764 - RNA, 19 nt, Artificial
  Chemically Synthesized
aauaggcuuugaugacuuu

SEQ ID NO: 765 - RNA, 19 nt, Artificial
  Chemically Synthesized
gaugacuuucugugcucag

SEQ ID NO: 766 - RNA, 19 nt, Artificial
  Chemically Synthesized
gucucuuuuacuugagacu

SEQ ID NO: 767 - RNA, 19 nt, Artificial
  Chemically Synthesized
gcuaucuuucuucagagca

SEQ ID NO: 768 - RNA, 19 nt, Artificial
  Chemically Synthesized
cccaaaggaagauauuuua

SEQ ID NO: 769 - RNA, 19 nt, Artificial
  Chemically Synthesized
caaacaucuuuggcaucac

SEQ ID NO: 770 - RNA, 19 nt, Artificial
  Chemically Synthesized
ccucuucucucccaguauu

SEQ ID NO: 771 - RNA, 19 nt, Artificial
  Chemically Synthesized
gcucagacuuucauuuauu

SEQ ID NO: 772 - RNA, 19 nt, Artificial
  Chemically Synthesized
cagaugcugucuuugguuu

SEQ ID NO: 773 - RNA, 19 nt, Artificial
  Chemically Synthesized
ggaaugaggaaagcaaacu

SEQ ID NO: 774 - RNA, 19 nt, Artificial
  Chemically Synthesized
gcuucacugucauuuccag

SEQ ID NO: 775 - RNA, 19 nt, Artificial
  Chemically Synthesized
ccuucuccagcuuggaaug

SEQ ID NO: 776 - RNA, 19 nt, Artificial
  Chemically Synthesized
agcauccaaaaucaguguu

SEQ ID NO: 777 - RNA, 19 nt, Artificial
  Chemically Synthesized
cuuuggcaucacauaaaaa

SEQ ID NO: 778 - RNA, 19 nt, Artificial
  Chemically Synthesized
gaaaugucaucugagcuuu

SEQ ID NO: 779 - RNA, 19 nt, Artificial
  Chemically Synthesized
ucacugucauuuccagaau

SEQ ID NO: 780 - RNA, 19 nt, Artificial
  Chemically Synthesized
ggcuuugaugacuuucugu

SEQ ID NO: 781 - RNA, 19 nt, Artificial
  Chemically Synthesized
ccauuauaucagcuggcau

SEQ ID NO: 782 - RNA, 19 nt, Artificial
  Chemically Synthesized
aaggcgcaauccaauauga

SEQ ID NO: 783 - RNA, 19 nt, Artificial
  Chemically Synthesized
gggaaugaggaaagcaaac

SEQ ID NO: 784 - RNA, 19 nt, Artificial
  Chemically Synthesized
gccgcgagcuaucuuucuu

SEQ ID NO: 785 - RNA, 19 nt, Artificial
  Chemically Synthesized
acgaggaauuuuucuccau

SEQ ID NO: 786 - RNA, 19 nt, Artificial
  Chemically Synthesized
accaaggagagagguagac

SEQ ID NO: 787 - RNA, 19 nt, Artificial
  Chemically Synthesized
gagcauuuucaaacaucuu

SEQ ID NO: 788 - RNA, 19 nt, Artificial
  Chemically Synthesized
acagcucucucuacaaaaa

SEQ ID NO: 789 - RNA, 19 nt, Artificial
  Chemically Synthesized
ggugcuucacugucauuuc

SEQ ID NO: 790 - RNA, 19 nt, Artificial
  Chemically Synthesized
ggaagauauuuuaagagca

SEQ ID NO: 791 - RNA, 19 nt, Artificial
  Chemically Synthesized
cauggucagucacuuaaua

SEQ ID NO: 792 - RNA, 19 nt, Artificial
  Chemically Synthesized
cauccaaaaucaguguuuu

SEQ ID NO: 793 - RNA, 19 nt, Artificial
  Chemically Synthesized
ggguaggucauggcauuga

SEQ ID NO: 794 - RNA, 19 nt, Artificial
  Chemically Synthesized
acugucauuuccagaaugu

SEQ ID NO: 795 - RNA, 19 nt, Artificial
  Chemically Synthesized
cgcgagcuaucuuucuuca

SEQ ID NO: 796 - RNA, 19 nt, Artificial
  Chemically Synthesized
gacgaggaauuuuucucca

SEQ ID NO: 797 - RNA, 19 nt, Artificial
  Chemically Synthesized
uggaguucuucacgaaaaa

SEQ ID NO: 798 - RNA, 19 nt, Artificial
  Chemically Synthesized
ggcuacuuggugaucagua

SEQ ID NO: 799 - RNA, 19 nt, Artificial
  Chemically Synthesized
gccuucuccagcuuggaau

SEQ ID NO: 800 - RNA, 19 nt, Artificial
  Chemically Synthesized
gacuuucugugcucagaug

SEQ ID NO: 801 - RNA, 19 nt, Artificial
  Chemically Synthesized
cucuuuuacuugagacuuu

SEQ ID NO: 802 - RNA, 19 nt, Artificial
  Chemically Synthesized
caaaggcgcaauccaauau

SEQ ID NO: 803 - RNA, 19 nt, Artificial
  Chemically Synthesized
uguuuagaguccggaggga

SEQ ID NO: 804 - RNA, 19 nt, Artificial
  Chemically Synthesized
gaucugggucaugcaguug

SEQ ID NO: 805 - RNA, 19 nt, Artificial
  Chemically Synthesized
gcauccaaaaucaguguuu

SEQ ID NO: 806 - RNA, 19 nt, Artificial
  Chemically Synthesized
gugcucagaugcugucuuu

SEQ ID NO: 807 - RNA, 19 nt, Artificial
  Chemically Synthesized
cgaggaauuuuucuccauu

SEQ ID NO: 808 - RNA, 19 nt, Artificial
  Chemically Synthesized
aguucuucacgaaaaagaa

SEQ ID NO: 809 - RNA, 19 nt, Artificial
  Chemically Synthesized
cucucucuacaaaaaguaa

SEQ ID NO: 810 - RNA, 19 nt, Artificial
  Chemically Synthesized
ucauggcauugaucugggu

SEQ ID NO: 811 - RNA, 19 nt, Artificial
  Chemically Synthesized
uggcauugaucugggucau

SEQ ID NO: 812 - RNA, 19 nt, Artificial
  Chemically Synthesized
guucaugcacucgcugaag

SEQ ID NO: 813 - RNA, 19 nt, Artificial
  Chemically Synthesized
cacugucauuuccagaaug

SEQ ID NO: 814 - RNA, 19 nt, Artificial
  Chemically Synthesized
caaaacuacugagcaagug

SEQ ID NO: 815 - RNA, 19 nt, Artificial
  Chemically Synthesized
aggaaagcaaacuggccau

SEQ ID NO: 816 - RNA, 19 nt, Artificial
  Chemically Synthesized
cagcuggcucagacuuuca

SEQ ID NO: 817 - RNA, 19 nt, Artificial
  Chemically Synthesized
cucguguaaaaaacgaaau

SEQ ID NO: 818 - RNA, 19 nt, Artificial
  Chemically Synthesized
aacacaaaguaaccacuua

SEQ ID NO: 819 - RNA, 19 nt, Artificial
  Chemically Synthesized
gcugaggguuuauuauauu

SEQ ID NO: 820 - RNA, 19 nt, Artificial
  Chemically Synthesized
ccguugggaaugaggaaag

SEQ ID NO: 821 - RNA, 19 nt, Artificial
  Chemically Synthesized
gcuacuuggugaucaguag

SEQ ID NO: 822 - RNA, 19 nt, Artificial
  Chemically Synthesized
cguguaaaaaacgaaaugu

SEQ ID NO: 823 - RNA, 19 nt, Artificial
  Chemically Synthesized
ggcgcaauccaauaugaac

SEQ ID NO: 824 - RNA, 19 nt, Artificial
  Chemically Synthesized
gugcauggucagucacuua

SEQ ID NO: 825 - RNA, 19 nt, Artificial
  Chemically Synthesized
gcauggucagucacuuaau

SEQ ID NO: 826 - RNA, 19 nt, Artificial
  Chemically Synthesized
guggcuacuuggugaucag

SEQ ID NO: 827 - RNA, 19 nt, Artificial
  Chemically Synthesized
gaggaauuuuucuccauua

SEQ ID NO: 828 - RNA, 19 nt, Artificial
  Chemically Synthesized
guuuagaguccggagggaa

SEQ ID NO: 829 - RNA, 19 nt, Artificial
  Chemically Synthesized
cguugggaaugaggaaagc

SEQ ID NO: 830 - RNA, 19 nt, Artificial
  Chemically Synthesized
ggcauugaucugggucaug

SEQ ID NO: 831 - RNA, 19 nt, Artificial
  Chemically Synthesized
gagcauccaaaaucagugu

SEQ ID NO: 832 - RNA, 19 nt, Artificial
  Chemically Synthesized
gaugcugucuuugguuuau

SEQ ID NO: 833 - RNA, 19 nt, Artificial
  Chemically Synthesized
ggauuccgcuguuaucagc

SEQ ID NO: 834 - RNA, 19 nt, Artificial
  Chemically Synthesized
gugcgcaccucgguauuaa

SEQ ID NO: 835 - RNA, 19 nt, Artificial
  Chemically Synthesized
gggauuccgcuguuaucag

SEQ ID NO: 836 - RNA, 19 nt, Artificial
  Chemically Synthesized
agcaagugcugaggguuua

SEQ ID NO: 837 - RNA, 19 nt, Artificial
  Chemically Synthesized
cacaaaguaaccacuuaau

SEQ ID NO: 838 - RNA, 19 nt, Artificial
  Chemically Synthesized
cucucccaguauucaaguu

SEQ ID NO: 839 - RNA, 19 nt, Artificial
  Chemically Synthesized
gagcaagugcugaggguuu

SEQ ID NO: 840 - RNA, 19 nt, Artificial
  Chemically Synthesized
agugcgcaccucgguauua

SEQ ID NO: 841 - RNA, 19 nt, Artificial
  Chemically Synthesized
gaaugccgcgagcuaucuu

SEQ ID NO: 842 - RNA, 19 nt, Artificial
  Chemically Synthesized
gugucucuuuuacuugaga

SEQ ID NO: 843 - RNA, 19 nt, Artificial
  Chemically Synthesized
cguucaugcacucgcugaa

SEQ ID NO: 844 - RNA, 19 nt, Artificial
  Chemically Synthesized
guucuucacgaaaaagaau

SEQ ID NO: 845 - RNA, 19 nt, Artificial
  Chemically Synthesized
aggcgcaauccaauaugaa

SEQ ID NO: 846 - RNA, 19 nt, Artificial
  Chemically Synthesized
cccguugggaaugaggaaa

SEQ ID NO: 847 - RNA, 19 nt, Artificial
  Chemically Synthesized
aggaccaaggagagaggua

SEQ ID NO: 848 - RNA, 19 nt, Artificial
  Chemically Synthesized
ggcucagacuuucauuuau

SEQ ID NO: 849 - RNA, 19 nt, Artificial
  Chemically Synthesized
ggaguucuucacgaaaaag

SEQ ID NO: 850 - RNA, 19 nt, Artificial
  Chemically Synthesized
cgcaauccaauaugaacau

SEQ ID NO: 851 - RNA, 19 nt, Artificial
  Chemically Synthesized
ggaaagcaaacuggccauc

SEQ ID NO: 852 - RNA, 19 nt, Artificial
  Chemically Synthesized
ggaagccuccaaacaccuu

SEQ ID NO: 853 - RNA, 19 nt, Artificial
  Chemically Synthesized
ggaggugcuucacugucau

SEQ ID NO: 854 - RNA, 19 nt, Artificial
  Chemically Synthesized
ggcaucacauaaaaaagaa

SEQ ID NO: 855 - RNA, 19 nt, Artificial
  Chemically Synthesized
gguaggucauggcauugau

SEQ ID NO: 856 - RNA, 19 nt, Artificial
  Chemically Synthesized
gaccaaggagagagguaga

SEQ ID NO: 857 - RNA, 19 nt, Artificial
  Chemically Synthesized
gcaagugcugaggguuuau

SEQ ID NO: 858 - RNA, 19 nt, Artificial
  Chemically Synthesized
gaggugcuucacugucauu

SEQ ID NO: 859 - RNA, 19 nt, Artificial
  Chemically Synthesized
gcaauccaauaugaacaua

SEQ ID NO: 860 - RNA, 19 nt, Artificial
  Chemically Synthesized
ggugaucaguagcgcuguu

SEQ ID NO: 861 - RNA, 23 nt, Artificial
  Chemically Synthesized
cauucuggaaaugacagugaagc

SEQ ID NO: 862 - RNA, 23 nt, Artificial
  Chemically Synthesized
acauucuggaaaugacagugaag

SEQ ID NO: 863 - RNA, 23 nt, Artificial
  Chemically Synthesized
gacauucuggaaaugacagugaa

SEQ ID NO: 864 - RNA, 23 nt, Artificial
  Chemically Synthesized
aacacugauuuuggaugcucuga

SEQ ID NO: 865 - RNA, 23 nt, Artificial
  Chemically Synthesized
aaacacugauuuuggaugcucug

SEQ ID NO: 866 - RNA, 23 nt, Artificial
  Chemically Synthesized
aaaacacugauuuuggaugcucu

SEQ ID NO: 867 - RNA, 23 nt, Artificial
  Chemically Synthesized
guauuaagugacugaccaugcac

SEQ ID NO: 868 - RNA, 23 nt, Artificial
  Chemically Synthesized
uguauuaagugacugaccaugca

SEQ ID NO: 869 - RNA, 23 nt, Artificial
  Chemically Synthesized
cuguauuaagugacugaccaugc

SEQ ID NO: 870 - RNA, 23 nt, Artificial
  Chemically Synthesized
gcuguauuaagugacugaccaug

SEQ ID NO: 871 - RNA, 23 nt, Artificial
  Chemically Synthesized
agcuguauuaagugacugaccau

SEQ ID NO: 872 - RNA, 23 nt, Artificial
  Chemically Synthesized
gcaucugagcacagaaagucauc

SEQ ID NO: 873 - RNA, 23 nt, Artificial
  Chemically Synthesized
agcaucugagcacagaaagucau

SEQ ID NO: 874 - RNA, 23 nt, Artificial
  Chemically Synthesized
aaagacagcaucugagcacagaa

SEQ ID NO: 875 - RNA, 23 nt, Artificial
  Chemically Synthesized
gugaagaacuccaaaaauaaaau

SEQ ID NO: 876 - RNA, 23 nt, Artificial
  Chemically Synthesized
cuuuuucgugaagaacuccaaaa

SEQ ID NO: 877 - RNA, 23 nt, Artificial
  Chemically Synthesized
ucuuuuucgugaagaacuccaaa

SEQ ID NO: 878 - RNA, 23 nt, Artificial
  Chemically Synthesized
agaucaaugccaugaccuacccc

SEQ ID NO: 879 - RNA, 23 nt, Artificial
  Chemically Synthesized
cagaucaaugccaugaccuaccc

SEQ ID NO: 880 - RNA, 23 nt, Artificial
  Chemically Synthesized
ccagaucaaugccaugaccuacc

SEQ ID NO: 881 - RNA, 23 nt, Artificial
  Chemically Synthesized
cccagaucaaugccaugaccuac

SEQ ID NO: 882 - RNA, 23 nt, Artificial
  Chemically Synthesized
acccagaucaaugccaugaccua

SEQ ID NO: 883 - RNA, 23 nt, Artificial
  Chemically Synthesized
auagcucgcggcauuccaagcug

SEQ ID NO: 884 - RNA, 23 nt, Artificial
  Chemically Synthesized
gauagcucgcggcauuccaagcu

SEQ ID NO: 885 - RNA, 23 nt, Artificial
  Chemically Synthesized
agauagcucgcggcauuccaagc

SEQ ID NO: 886 - RNA, 23 nt, Artificial
  Chemically Synthesized
aagauagcucgcggcauuccaag

SEQ ID NO: 887 - RNA, 23 nt, Artificial
  Chemically Synthesized
aaagauagcucgcggcauuccaa

SEQ ID NO: 888 - RNA, 23 nt, Artificial
  Chemically Synthesized
cgcuacugaucaccaaguagcca

SEQ ID NO: 889 - RNA, 23 nt, Artificial
  Chemically Synthesized
gcgcuacugaucaccaaguagcc

SEQ ID NO: 890 - RNA, 23 nt, Artificial
  Chemically Synthesized
agcgcuacugaucaccaaguagc

SEQ ID NO: 891 - RNA, 23 nt, Artificial
  Chemically Synthesized
augaaagucugagccagcugaaa

SEQ ID NO: 892 - RNA, 23 nt, Artificial
  Chemically Synthesized
aaugaaagucugagccagcugaa

SEQ ID NO: 893 - RNA, 23 nt, Artificial
  Chemically Synthesized
aaaugaaagucugagccagcuga

SEQ ID NO: 894 - RNA, 23 nt, Artificial
  Chemically Synthesized
uggaaaugacagugaagcaccuc

SEQ ID NO: 895 - RNA, 23 nt, Artificial
  Chemically Synthesized
cuggaaaugacagugaagcaccu

SEQ ID NO: 896 - RNA, 23 nt, Artificial
  Chemically Synthesized
ucuggaaaugacagugaagcacc

SEQ ID NO: 897 - RNA, 23 nt, Artificial
  Chemically Synthesized
ccggacucuaaacaggaacuuga

SEQ ID NO: 898 - RNA, 23 nt, Artificial
  Chemically Synthesized
ccaguuugcuuuccucauuccca

SEQ ID NO: 899 - RNA, 23 nt, Artificial
  Chemically Synthesized
gagcuggugcugauaacagcgga

SEQ ID NO: 900 - RNA, 23 nt, Artificial
  Chemically Synthesized
uggaacagcgcuacugaucacca

SEQ ID NO: 901 - RNA, 23 nt, Artificial
  Chemically Synthesized
ccaugcacuauauuuguauauau

SEQ ID NO: 902 - RNA, 23 nt, Artificial
  Chemically Synthesized
accaugcacuauauuuguauaua

SEQ ID NO: 903 - RNA, 23 nt, Artificial
  Chemically Synthesized
gaccaugcacuauauuuguauau

SEQ ID NO: 904 - RNA, 23 nt, Artificial
  Chemically Synthesized
ugaccaugcacuauauuuguaua

SEQ ID NO: 905 - RNA, 23 nt, Artificial
  Chemically Synthesized
cugaccaugcacuauauuuguau

SEQ ID NO: 906 - RNA, 23 nt, Artificial
  Chemically Synthesized
ccagcugaaaacacugauuuugg

SEQ ID NO: 907 - RNA, 23 nt, Artificial
  Chemically Synthesized
gccagcugaaaacacugauuuug

SEQ ID NO: 908 - RNA, 23 nt, Artificial
  Chemically Synthesized
agccagcugaaaacacugauuuu

SEQ ID NO: 909 - RNA, 23 nt, Artificial
  Chemically Synthesized
ugugaugccaaagauguuugaaa

SEQ ID NO: 910 - RNA, 23 nt, Artificial
  Chemically Synthesized
augugaugccaaagauguuugaa

SEQ ID NO: 911 - RNA, 23 nt, Artificial
  Chemically Synthesized
uaugugaugccaaagauguuuga

SEQ ID NO: 912 - RNA, 23 nt, Artificial
  Chemically Synthesized
cuuuuuguagagagagcuguauu

SEQ ID NO: 913 - RNA, 23 nt, Artificial
  Chemically Synthesized
acuuuuuguagagagagcuguau

SEQ ID NO: 914 - RNA, 23 nt, Artificial
  Chemically Synthesized
uacuuuuuguagagagagcugua

SEQ ID NO: 915 - RNA, 23 nt, Artificial
  Chemically Synthesized
gaaagauagcucgcggcauucca

SEQ ID NO: 916 - RNA, 23 nt, Artificial
  Chemically Synthesized
agaaagauagcucgcggcauucc

SEQ ID NO: 917 - RNA, 23 nt, Artificial
  Chemically Synthesized
aagaaagauagcucgcggcauuc

SEQ ID NO: 918 - RNA, 23 nt, Artificial
  Chemically Synthesized
gaagaaagauagcucgcggcauu

SEQ ID NO: 919 - RNA, 23 nt, Artificial
  Chemically Synthesized
ugaagaaagauagcucgcggcau

SEQ ID NO: 920 - RNA, 23 nt, Artificial
  Chemically Synthesized
gagcuguauuaagugacugacca

SEQ ID NO: 921 - RNA, 23 nt, Artificial
  Chemically Synthesized
agagcuguauuaagugacugacc

SEQ ID NO: 922 - RNA, 23 nt, Artificial
  Chemically Synthesized
gagagcuguauuaagugacugac

SEQ ID NO: 923 - RNA, 23 nt, Artificial
  Chemically Synthesized
agagagcuguauuaagugacuga

SEQ ID NO: 924 - RNA, 23 nt, Artificial
  Chemically Synthesized
agagagagcuguauuaagugacu

SEQ ID NO: 925 - RNA, 23 nt, Artificial
  Chemically Synthesized
uagagagagcuguauuaagugac

SEQ ID NO: 926 - RNA, 23 nt, Artificial
  Chemically Synthesized
aaagucaucaaagccuauuaugg

SEQ ID NO: 927 - RNA, 23 nt, Artificial
  Chemically Synthesized
gaaagucucaaguaaaagagaca

SEQ ID NO: 928 - RNA, 23 nt, Artificial
  Chemically Synthesized
ugaaagucucaaguaaaagagac

SEQ ID NO: 929 - RNA, 23 nt, Artificial
  Chemically Synthesized
uaguuuugugaaagucucaagua

SEQ ID NO: 930 - RNA, 23 nt, Artificial
  Chemically Synthesized
guaguuuugugaaagucucaagu

SEQ ID NO: 931 - RNA, 23 nt, Artificial
  Chemically Synthesized
aguaguuuugugaaagucucaag

SEQ ID NO: 932 - RNA, 23 nt, Artificial
  Chemically Synthesized
caguaguuuugugaaagucucaa

SEQ ID NO: 933 - RNA, 23 nt, Artificial
  Chemically Synthesized
gagagagcuguauuaagugacug

SEQ ID NO: 934 - RNA, 23 nt, Artificial
  Chemically Synthesized
gaagaggacuuuuuugauuaagu

SEQ ID NO: 935 - RNA, 23 nt, Artificial
  Chemically Synthesized
uccggacucuaaacaggaacuug

SEQ ID NO: 936 - RNA, 23 nt, Artificial
  Chemically Synthesized
cuccggacucuaaacaggaacuu

SEQ ID NO: 937 - RNA, 23 nt, Artificial
  Chemically Synthesized
ccuccggacucuaaacaggaacu

SEQ ID NO: 938 - RNA, 23 nt, Artificial
  Chemically Synthesized
cccuccggacucuaaacaggaac

SEQ ID NO: 939 - RNA, 23 nt, Artificial
  Chemically Synthesized
ucccuccggacucuaaacaggaa

SEQ ID NO: 940 - RNA, 23 nt, Artificial
  Chemically Synthesized
cugcaugacccagaucaaugcca

SEQ ID NO: 941 - RNA, 23 nt, Artificial
  Chemically Synthesized
auuauggagaaaagacgaagagc

SEQ ID NO: 942 - RNA, 23 nt, Artificial
  Chemically Synthesized
uauuauggagaaaagacgaagag

SEQ ID NO: 943 - RNA, 23 nt, Artificial
  Chemically Synthesized
cuauuauggagaaaagacgaaga

SEQ ID NO: 944 - RNA, 23 nt, Artificial
  Chemically Synthesized
ccuauuauggagaaaagacgaag

SEQ ID NO: 945 - RNA, 23 nt, Artificial
  Chemically Synthesized
auauuggauugcgccuuuguauu

SEQ ID NO: 946 - RNA, 23 nt, Artificial
  Chemically Synthesized
cauauuggauugcgccuuuguau

SEQ ID NO: 947 - RNA, 23 nt, Artificial
  Chemically Synthesized
ucauauuggauugcgccuuugua

SEQ ID NO: 948 - RNA, 23 nt, Artificial
  Chemically Synthesized
uaagugacugaccaugcacuaua

SEQ ID NO: 949 - RNA, 23 nt, Artificial
  Chemically Synthesized
uuaagugacugaccaugcacuau

SEQ ID NO: 950 - RNA, 23 nt, Artificial
  Chemically Synthesized
auuaagugacugaccaugcacua

SEQ ID NO: 951 - RNA, 23 nt, Artificial
  Chemically Synthesized
uauuaagugacugaccaugcacu

SEQ ID NO: 952 - RNA, 23 nt, Artificial
  Chemically Synthesized
aggacuuuuuugauuaagugguu

SEQ ID NO: 953 - RNA, 23 nt, Artificial
  Chemically Synthesized
gaggacuuuuuugauuaaguggu

SEQ ID NO: 954 - RNA, 23 nt, Artificial
  Chemically Synthesized
agaggacuuuuuugauuaagugg

SEQ ID NO: 955 - RNA, 23 nt, Artificial
  Chemically Synthesized
aagaggacuuuuuugauuaagug

SEQ ID NO: 956 - RNA, 23 nt, Artificial
  Chemically Synthesized
ccucucuucccuccggacucuaa

SEQ ID NO: 957 - RNA, 23 nt, Artificial
  Chemically Synthesized
aaccaaagacagcaucugagcac

SEQ ID NO: 958 - RNA, 23 nt, Artificial
  Chemically Synthesized
aaaccaaagacagcaucugagca

SEQ ID NO: 959 - RNA, 23 nt, Artificial
  Chemically Synthesized
uaaaccaaagacagcaucugagc

SEQ ID NO: 960 - RNA, 23 nt, Artificial
  Chemically Synthesized
auaaaccaaagacagcaucugag

SEQ ID NO: 961 - RNA, 23 nt, Artificial
  Chemically Synthesized
gauaaaccaaagacagcaucuga

SEQ ID NO: 962 - RNA, 23 nt, Artificial
  Chemically Synthesized
acugaccaugcacuauauuugua

SEQ ID NO: 963 - RNA, 23 nt, Artificial
  Chemically Synthesized
aaaugccagcugauauaauggag

SEQ ID NO: 964 - RNA, 23 nt, Artificial
  Chemically Synthesized
aaaaugccagcugauauaaugga

SEQ ID NO: 965 - RNA, 23 nt, Artificial
  Chemically Synthesized
ugaauacugggagagaagaggac

SEQ ID NO: 966 - RNA, 23 nt, Artificial
  Chemically Synthesized
uugaauacugggagagaagagga

SEQ ID NO: 967 - RNA, 23 nt, Artificial
  Chemically Synthesized
cuaaacaggaacuugaauacugg

SEQ ID NO: 968 - RNA, 23 nt, Artificial
  Chemically Synthesized
ucuaaacaggaacuugaauacug

SEQ ID NO: 969 - RNA, 23 nt, Artificial
  Chemically Synthesized
ucaguaguuuugugaaagucuca

SEQ ID NO: 970 - RNA, 23 nt, Artificial
  Chemically Synthesized
gauguuugaaaaugcucuuaaaa

SEQ ID NO: 971 - RNA, 23 nt, Artificial
  Chemically Synthesized
agauguuugaaaaugcucuuaaa

SEQ ID NO: 972 - RNA, 23 nt, Artificial
  Chemically Synthesized
aagauguuugaaaaugcucuuaa

SEQ ID NO: 973 - RNA, 23 nt, Artificial
  Chemically Synthesized
aaagauguuugaaaaugcucuua

SEQ ID NO: 974 - RNA, 23 nt, Artificial
  Chemically Synthesized
caaagauguuugaaaaugcucuu

SEQ ID NO: 975 - RNA, 23 nt, Artificial
  Chemically Synthesized
gugguuacuuuguguuuuuuuaa

SEQ ID NO: 976 - RNA, 23 nt, Artificial
  Chemically Synthesized
agugguuacuuuguguuuuuuua

SEQ ID NO: 977 - RNA, 23 nt, Artificial
  Chemically Synthesized
aagugguuacuuuguguuuuuuu

SEQ ID NO: 978 - RNA, 23 nt, Artificial
  Chemically Synthesized
uaagugguuacuuuguguuuuuu

SEQ ID NO: 979 - RNA, 23 nt, Artificial
  Chemically Synthesized
uuaagugguuacuuuguguuuuu

SEQ ID NO: 980 - RNA, 23 nt, Artificial
  Chemically Synthesized
auacugggagagaagaggacuuu

SEQ ID NO: 981 - RNA, 23 nt, Artificial
  Chemically Synthesized
aauacugggagagaagaggacuu

SEQ ID NO: 982 - RNA, 23 nt, Artificial
  Chemically Synthesized
acgugcgagggcguuaauaccga

SEQ ID NO: 983 - RNA, 23 nt, Artificial
  Chemically Synthesized
cacgugcgagggcguuaauaccg

SEQ ID NO: 984 - RNA, 23 nt, Artificial
  Chemically Synthesized
ccacgugcgagggcguuaauacc

SEQ ID NO: 985 - RNA, 23 nt, Artificial
  Chemically Synthesized
uccacgugcgagggcguuaauac

SEQ ID NO: 986 - RNA, 23 nt, Artificial
  Chemically Synthesized
guccacgugcgagggcguuaaua

SEQ ID NO: 987 - RNA, 23 nt, Artificial
  Chemically Synthesized
uauaaaagcucagaugacauuuc

SEQ ID NO: 988 - RNA, 23 nt, Artificial
  Chemically Synthesized
uuauaaaagcucagaugacauuu

SEQ ID NO: 989 - RNA, 23 nt, Artificial
  Chemically Synthesized
auuauaaaagcucagaugacauu

SEQ ID NO: 990 - RNA, 23 nt, Artificial
  Chemically Synthesized
uauuauaaaagcucagaugacau

SEQ ID NO: 991 - RNA, 23 nt, Artificial
  Chemically Synthesized
guauuauaaaagcucagaugaca

SEQ ID NO: 992 - RNA, 23 nt, Artificial
  Chemically Synthesized
cucagaugacauuucguuuuuua

SEQ ID NO: 993 - RNA, 23 nt, Artificial
  Chemically Synthesized
gcucagaugacauuucguuuuuu

SEQ ID NO: 994 - RNA, 23 nt, Artificial
  Chemically Synthesized
agcucagaugacauuucguuuuu

SEQ ID NO: 995 - RNA, 23 nt, Artificial
  Chemically Synthesized
aagcucagaugacauuucguuuu

SEQ ID NO: 996 - RNA, 23 nt, Artificial
  Chemically Synthesized
aaagcucagaugacauuucguuu

SEQ ID NO: 997 - RNA, 23 nt, Artificial
  Chemically Synthesized
gccaaagauguuugaaaaugcuc

SEQ ID NO: 998 - RNA, 23 nt, Artificial
  Chemically Synthesized
ccucagcacuugcucaguaguuu

SEQ ID NO: 999 - RNA, 23 nt, Artificial
  Chemically Synthesized
cccucagcacuugcucaguaguu

SEQ ID NO: 1000 - RNA, 23 nt, Artificial
  Chemically Synthesized
acccucagcacuugcucaguagu

SEQ ID NO: 1001 - RNA, 23 nt, Artificial
  Chemically Synthesized
aacccucagcacuugcucaguag

SEQ ID NO: 1002 - RNA, 23 nt, Artificial
  Chemically Synthesized
aaacccucagcacuugcucagua

SEQ ID NO: 1003 - RNA, 23 nt, Artificial
  Chemically Synthesized
uucauauuggauugcgccuuugu

SEQ ID NO: 1004 - RNA, 23 nt, Artificial
  Chemically Synthesized
guucauauuggauugcgccuuug

SEQ ID NO: 1005 - RNA, 23 nt, Artificial
  Chemically Synthesized
uguucauauuggauugcgccuuu

SEQ ID NO: 1006 - RNA, 23 nt, Artificial
  Chemically Synthesized
ucuccuugguccuggaacagcgc

SEQ ID NO: 1007 - RNA, 23 nt, Artificial
  Chemically Synthesized
cucuccuugguccuggaacagcg

SEQ ID NO: 1008 - RNA, 23 nt, Artificial
  Chemically Synthesized
ucucuccuugguccuggaacagc

SEQ ID NO: 1009 - RNA, 23 nt, Artificial
  Chemically Synthesized
cucucuccuugguccuggaacag

SEQ ID NO: 1010 - RNA, 23 nt, Artificial
  Chemically Synthesized
ccucucuccuugguccuggaaca

SEQ ID NO: 1011 - RNA, 23 nt, Artificial
  Chemically Synthesized
ccaaagauguuugaaaaugcucu

SEQ ID NO: 1012 - RNA, 23 nt, Artificial
  Chemically Synthesized
uuucguuuuuuacacgagauuuc

SEQ ID NO: 1013 - RNA, 23 nt, Artificial
  Chemically Synthesized
auuucguuuuuuacacgagauuu

SEQ ID NO: 1014 - RNA, 23 nt, Artificial
  Chemically Synthesized
cauuucguuuuuuacacgagauu

SEQ ID NO: 1015 - RNA, 23 nt, Artificial
  Chemically Synthesized
acauuucguuuuuuacacgagau

SEQ ID NO: 1016 - RNA, 23 nt, Artificial
  Chemically Synthesized
gacauuucguuuuuuacacgaga

SEQ ID NO: 1017 - RNA, 23 nt, Artificial
  Chemically Synthesized
aacaggaacuugaauacugggag

SEQ ID NO: 1018 - RNA, 23 nt, Artificial
  Chemically Synthesized
gcuucagcgagugcaugaacgag

SEQ ID NO: 1019 - RNA, 23 nt, Artificial
  Chemically Synthesized
ggcuucagcgagugcaugaacga

SEQ ID NO: 1020 - RNA, 23 nt, Artificial
  Chemically Synthesized
cggcuucagcgagugcaugaacg

SEQ ID NO: 1021 - RNA, 23 nt, Artificial
  Chemically Synthesized
ccggcuucagcgagugcaugaac

SEQ ID NO: 1022 - RNA, 23 nt, Artificial
  Chemically Synthesized
gccggcuucagcgagugcaugaa

SEQ ID NO: 1023 - RNA, 23 nt, Artificial
  Chemically Synthesized
gaaaacacugauuuuggaugcuc

SEQ ID NO: 1024 - RNA, 23 nt, Artificial
  Chemically Synthesized
cagaugacauuucguuuuuuaca

SEQ ID NO: 1025 - RNA, 23 nt, Artificial
  Chemically Synthesized
ucagaugacauuucguuuuuuac

SEQ ID NO: 1026 - RNA, 23 nt, Artificial
  Chemically Synthesized
aaaagcucagaugacauuucguu

SEQ ID NO: 1027 - RNA, 23 nt, Artificial
  Chemically Synthesized
uaaaagcucagaugacauuucgu

SEQ ID NO: 1028 - RNA, 23 nt, Artificial
  Chemically Synthesized
gaauacugggagagaagaggacu

SEQ ID NO: 1029 - RNA, 23 nt, Artificial
  Chemically Synthesized
aaacaggaacuugaauacuggga

SEQ ID NO: 1030 - RNA, 23 nt, Artificial
  Chemically Synthesized
uaaacaggaacuugaauacuggg

SEQ ID NO: 1031 - RNA, 23 nt, Artificial
  Chemically Synthesized
cgauggccaguuugcuuuccuca

SEQ ID NO: 1032 - RNA, 23 nt, Artificial
  Chemically Synthesized
acugaucaccaaguagccacaaa

SEQ ID NO: 1033 - RNA, 23 nt, Artificial
  Chemically Synthesized
uacugaucaccaaguagccacaa

SEQ ID NO: 1034 - RNA, 23 nt, Artificial
  Chemically Synthesized
cuacugaucaccaaguagccaca

SEQ ID NO: 1035 - RNA, 23 nt, Artificial
  Chemically Synthesized
caaagacagcaucugagcacaga

SEQ ID NO: 1036 - RNA, 23 nt, Artificial
  Chemically Synthesized
ccaaagacagcaucugagcacag

SEQ ID NO: 1037 - RNA, 23 nt, Artificial
  Chemically Synthesized
accaaagacagcaucugagcaca

SEQ ID NO: 1038 - RNA, 23 nt, Artificial
  Chemically Synthesized
acaccggauaaaccaaagacagc

SEQ ID NO: 1039 - RNA, 23 nt, Artificial
  Chemically Synthesized
gacaccggauaaaccaaagacag

SEQ ID NO: 1040 - RNA, 23 nt, Artificial
  Chemically Synthesized
aagucucaaguaaaagagacaca

SEQ ID NO: 1041 - RNA, 23 nt, Artificial
  Chemically Synthesized
aaagucucaaguaaaagagacac

SEQ ID NO: 1042 - RNA, 23 nt, Artificial
  Chemically Synthesized
aacgcagugucaccuuccagcgg

SEQ ID NO: 1043 - RNA, 23 nt, Artificial
  Chemically Synthesized
caacgcagugucaccuuccagcg

SEQ ID NO: 1044 - RNA, 23 nt, Artificial
  Chemically Synthesized
ccaacgcagugucaccuuccagc

SEQ ID NO: 1045 - RNA, 23 nt, Artificial
  Chemically Synthesized
cccaacgcagugucaccuuccag

SEQ ID NO: 1046 - RNA, 23 nt, Artificial
  Chemically Synthesized
ccccaacgcagugucaccuucca

SEQ ID NO: 1047 - RNA, 23 nt, Artificial
  Chemically Synthesized
gacccagaucaaugccaugaccu

SEQ ID NO: 1048 - RNA, 23 nt, Artificial
  Chemically Synthesized
ugacccagaucaaugccaugacc

SEQ ID NO: 1049 - RNA, 23 nt, Artificial
  Chemically Synthesized
augacccagaucaaugccaugac

SEQ ID NO: 1050 - RNA, 23 nt, Artificial
  Chemically Synthesized
caugacccagaucaaugccauga

SEQ ID NO: 1051 - RNA, 23 nt, Artificial
  Chemically Synthesized
gcaugacccagaucaaugccaug

SEQ ID NO: 1052 - RNA, 23 nt, Artificial
  Chemically Synthesized
gagugcaugaacgaggugacccg

SEQ ID NO: 1053 - RNA, 23 nt, Artificial
  Chemically Synthesized
cgagugcaugaacgaggugaccc

SEQ ID NO: 1054 - RNA, 23 nt, Artificial
  Chemically Synthesized
gcgagugcaugaacgaggugacc

SEQ ID NO: 1055 - RNA, 23 nt, Artificial
  Chemically Synthesized
agcgagugcaugaacgaggugac

SEQ ID NO: 1056 - RNA, 23 nt, Artificial
  Chemically Synthesized
cagcgagugcaugaacgagguga

SEQ ID NO: 1057 - RNA, 23 nt, Artificial
  Chemically Synthesized
cuggagaaggcggacauucugga

SEQ ID NO: 1058 - RNA, 23 nt, Artificial
  Chemically Synthesized
cugaagaaagauagcucgcggca

SEQ ID NO: 1059 - RNA, 23 nt, Artificial
  Chemically Synthesized
gcacuugcucaguaguuuuguga

SEQ ID NO: 1060 - RNA, 23 nt, Artificial
  Chemically Synthesized
agcacuugcucaguaguuuugug

SEQ ID NO: 1061 - RNA, 23 nt, Artificial
  Chemically Synthesized
cagcacuugcucaguaguuuugu

SEQ ID NO: 1062 - RNA, 23 nt, Artificial
  Chemically Synthesized
ucagcacuugcucaguaguuuug

SEQ ID NO: 1063 - RNA, 23 nt, Artificial
  Chemically Synthesized
cucagcacuugcucaguaguuuu

SEQ ID NO: 1064 - RNA, 23 nt, Artificial
  Chemically Synthesized
auaaaagcucagaugacauuucg

SEQ ID NO: 1065 - RNA, 23 nt, Artificial
  Chemically Synthesized
aagaaguuacuuuuuguagagag

SEQ ID NO: 1066 - RNA, 23 nt, Artificial
  Chemically Synthesized
uaagaaguuacuuuuuguagaga

SEQ ID NO: 1067 - RNA, 23 nt, Artificial
  Chemically Synthesized
cuaagaaguuacuuuuuguagag

SEQ ID NO: 1068 - RNA, 23 nt, Artificial
  Chemically Synthesized
uucccuccggacucuaaacagga

SEQ ID NO: 1069 - RNA, 23 nt, Artificial
  Chemically Synthesized
gagccagcugaaaacacugauuu

SEQ ID NO: 1070 - RNA, 23 nt, Artificial
  Chemically Synthesized
ugagccagcugaaaacacugauu

SEQ ID NO: 1071 - RNA, 23 nt, Artificial
  Chemically Synthesized
cucaguaguuuugugaaagucuc

SEQ ID NO: 1072 - RNA, 23 nt, Artificial
  Chemically Synthesized
ugcaugacccagaucaaugccau

SEQ ID NO: 1073 - RNA, 23 nt, Artificial
  Chemically Synthesized
ucugaagaaagauagcucgcggc

SEQ ID NO: 1074 - RNA, 23 nt, Artificial
  Chemically Synthesized
cucugaagaaagauagcucgcgg

SEQ ID NO: 1075 - RNA, 23 nt, Artificial
  Chemically Synthesized
uucuuuuucgugaagaacuccaa

SEQ ID NO: 1076 - RNA, 23 nt, Artificial
  Chemically Synthesized
uuuaugugaugccaaagauguuu

SEQ ID NO: 1077 - RNA, 23 nt, Artificial
  Chemically Synthesized
uuuuaugugaugccaaagauguu

SEQ ID NO: 1078 - RNA, 23 nt, Artificial
  Chemically Synthesized
uuuuuaugugaugccaaagaugu

SEQ ID NO: 1079 - RNA, 23 nt, Artificial
  Chemically Synthesized
uuuuuuaugugaugccaaagaug

SEQ ID NO: 1080 - RNA, 23 nt, Artificial
  Chemically Synthesized
cgccuuuguauuauaaaagcuca

SEQ ID NO: 1081 - RNA, 23 nt, Artificial
  Chemically Synthesized
uaauaaacccucagcacuugcuc

SEQ ID NO: 1082 - RNA, 23 nt, Artificial
  Chemically Synthesized
auaauaaacccucagcacuugcu

SEQ ID NO: 1083 - RNA, 23 nt, Artificial
  Chemically Synthesized
uauaauaaacccucagcacuugc

SEQ ID NO: 1084 - RNA, 23 nt, Artificial
  Chemically Synthesized
auauaauaaacccucagcacuug

SEQ ID NO: 1085 - RNA, 23 nt, Artificial
  Chemically Synthesized
aauauaauaaacccucagcacuu

SEQ ID NO: 1086 - RNA, 23 nt, Artificial
  Chemically Synthesized
aaauauaauaaacccucagcacu

SEQ ID NO: 1087 - RNA, 23 nt, Artificial
  Chemically Synthesized
aaaauauaauaaacccucagcac

SEQ ID NO: 1088 - RNA, 23 nt, Artificial
  Chemically Synthesized
caaaauauaauaaacccucagca

SEQ ID NO: 1089 - RNA, 23 nt, Artificial
  Chemically Synthesized
agaggcggcuaagguguuuggag

SEQ ID NO: 1090 - RNA, 23 nt, Artificial
  Chemically Synthesized
gagaggcggcuaagguguuugga

SEQ ID NO: 1091 - RNA, 23 nt, Artificial
  Chemically Synthesized
ggagaggcggcuaagguguuugg

SEQ ID NO: 1092 - RNA, 23 nt, Artificial
  Chemically Synthesized
uggagaggcggcuaagguguuug

SEQ ID NO: 1093 - RNA, 23 nt, Artificial
  Chemically Synthesized
cuggagaggcggcuaagguguuu

SEQ ID NO: 1094 - RNA, 23 nt, Artificial
  Chemically Synthesized
gcuggagaaggcggacauucugg

SEQ ID NO: 1095 - RNA, 23 nt, Artificial
  Chemically Synthesized
agcuggagaaggcggacauucug

SEQ ID NO: 1096 - RNA, 23 nt, Artificial
  Chemically Synthesized
aagcuggagaaggcggacauucu

SEQ ID NO: 1097 - RNA, 23 nt, Artificial
  Chemically Synthesized
uuaugugaugccaaagauguuug

SEQ ID NO: 1098 - RNA, 23 nt, Artificial
  Chemically Synthesized
ucagcgagugcaugaacgaggug

SEQ ID NO: 1099 - RNA, 23 nt, Artificial
  Chemically Synthesized
uucagcgagugcaugaacgaggu

SEQ ID NO: 1100 - RNA, 23 nt, Artificial
  Chemically Synthesized
cuucagcgagugcaugaacgagg

SEQ ID NO: 1101 - RNA, 23 nt, Artificial
  Chemically Synthesized
agccagugucaacacgacaccgg

SEQ ID NO: 1102 - RNA, 23 nt, Artificial
  Chemically Synthesized
cagccagugucaacacgacaccg

SEQ ID NO: 1103 - RNA, 23 nt, Artificial
  Chemically Synthesized
ccagccagugucaacacgacacc

SEQ ID NO: 1104 - RNA, 23 nt, Artificial
  Chemically Synthesized
cccagccagugucaacacgacac

SEQ ID NO: 1105 - RNA, 23 nt, Artificial
  Chemically Synthesized
ccccagccagugucaacacgaca

SEQ ID NO: 1106 - RNA, 23 nt, Artificial
  Chemically Synthesized
cuaagguguuuggaggcuuccag

SEQ ID NO: 1107 - RNA, 23 nt, Artificial
  Chemically Synthesized
gcuaagguguuuggaggcuucca

SEQ ID NO: 1108 - RNA, 23 nt, Artificial
  Chemically Synthesized
ggcuaagguguuuggaggcuucc

SEQ ID NO: 1109 - RNA, 23 nt, Artificial
  Chemically Synthesized
cggcuaagguguuuggaggcuuc

SEQ ID NO: 1110 - RNA, 23 nt, Artificial
  Chemically Synthesized
gcggcuaagguguuuggaggcuu

SEQ ID NO: 1111 - RNA, 23 nt, Artificial
  Chemically Synthesized
agugcaugaacgaggugacccgc

SEQ ID NO: 1112 - RNA, 23 nt, Artificial
  Chemically Synthesized
aaaugacagugaagcaccuccgg

SEQ ID NO: 1113 - RNA, 23 nt, Artificial
  Chemically Synthesized
gaaaugacagugaagcaccuccg

SEQ ID NO: 1114 - RNA, 23 nt, Artificial
  Chemically Synthesized
ggaaaugacagugaagcaccucc

SEQ ID NO: 1115 - RNA, 23 nt, Artificial
  Chemically Synthesized
gauuucuuuuuuaugugaugcca

SEQ ID NO: 1116 - RNA, 23 nt, Artificial
  Chemically Synthesized
auuaagugguuacuuuguguuuu

SEQ ID NO: 1117 - RNA, 23 nt, Artificial
  Chemically Synthesized
agguguuuggaggcuuccaggug

SEQ ID NO: 1118 - RNA, 23 nt, Artificial
  Chemically Synthesized
aagguguuuggaggcuuccaggu

SEQ ID NO: 1119 - RNA, 23 nt, Artificial
  Chemically Synthesized
uaagguguuuggaggcuuccagg

SEQ ID NO: 1120 - RNA, 23 nt, Artificial
  Chemically Synthesized
cugagccagcugaaaacacugau

SEQ ID NO: 1121 - RNA, 23 nt, Artificial
  Chemically Synthesized
ucugagccagcugaaaacacuga

SEQ ID NO: 1122 - RNA, 23 nt, Artificial
  Chemically Synthesized
gucugagccagcugaaaacacug

SEQ ID NO: 1123 - RNA, 23 nt, Artificial
  Chemically Synthesized
gcucuuaaaauaucuuccuuugg

SEQ ID NO: 1124 - RNA, 23 nt, Artificial
  Chemically Synthesized
ugcucuuaaaauaucuuccuuug

SEQ ID NO: 1125 - RNA, 23 nt, Artificial
  Chemically Synthesized
augcucuuaaaauaucuuccuuu

SEQ ID NO: 1126 - RNA, 23 nt, Artificial
  Chemically Synthesized
aaugcucuuaaaauaucuuccuu

SEQ ID NO: 1127 - RNA, 23 nt, Artificial
  Chemically Synthesized
aaaugcucuuaaaauaucuuccu

SEQ ID NO: 1128 - RNA, 23 nt, Artificial
  Chemically Synthesized
ccgauggccaguuugcuuuccuc

SEQ ID NO: 1129 - RNA, 23 nt, Artificial
  Chemically Synthesized
cccgauggccaguuugcuuuccu

SEQ ID NO: 1130 - RNA, 23 nt, Artificial
  Chemically Synthesized
ucccgauggccaguuugcuuucc

SEQ ID NO: 1131 - RNA, 23 nt, Artificial
  Chemically Synthesized
cucccgauggccaguuugcuuuc

SEQ ID NO: 1132 - RNA, 23 nt, Artificial
  Chemically Synthesized
gcucccgauggccaguuugcuuu

SEQ ID NO: 1133 - RNA, 23 nt, Artificial
  Chemically Synthesized
guuaauaccgaggugcgcacucg

SEQ ID NO: 1134 - RNA, 23 nt, Artificial
  Chemically Synthesized
cguuaauaccgaggugcgcacuc

SEQ ID NO: 1135 - RNA, 23 nt, Artificial
  Chemically Synthesized
gcguuaauaccgaggugcgcacu

SEQ ID NO: 1136 - RNA, 23 nt, Artificial
  Chemically Synthesized
ggcguuaauaccgaggugcgcac

SEQ ID NO: 1137 - RNA, 23 nt, Artificial
  Chemically Synthesized
gggcguuaauaccgaggugcgca

SEQ ID NO: 1138 - RNA, 23 nt, Artificial
  Chemically Synthesized
gauuaagugguuacuuuguguuu

SEQ ID NO: 1139 - RNA, 23 nt, Artificial
  Chemically Synthesized
uaaaugaaagucugagccagcug

SEQ ID NO: 1140 - RNA, 23 nt, Artificial
  Chemically Synthesized
auaaaugaaagucugagccagcu

SEQ ID NO: 1141 - RNA, 23 nt, Artificial
  Chemically Synthesized
aauaaaugaaagucugagccagc

SEQ ID NO: 1142 - RNA, 23 nt, Artificial
  Chemically Synthesized
gaauaaaugaaagucugagccag

SEQ ID NO: 1143 - RNA, 23 nt, Artificial
  Chemically Synthesized
agaauaaaugaaagucugagcca

SEQ ID NO: 1144 - RNA, 23 nt, Artificial
  Chemically Synthesized
aagaauaaaugaaagucugagcc

SEQ ID NO: 1145 - RNA, 23 nt, Artificial
  Chemically Synthesized
caagaauaaaugaaagucugagc

SEQ ID NO: 1146 - RNA, 23 nt, Artificial
  Chemically Synthesized
gcaagaauaaaugaaagucugag

SEQ ID NO: 1147 - RNA, 23 nt, Artificial
  Chemically Synthesized
caucugagcacagaaagucauca

SEQ ID NO: 1148 - RNA, 23 nt, Artificial
  Chemically Synthesized
ugacauuucguuuuuuacacgag

SEQ ID NO: 1149 - RNA, 23 nt, Artificial
  Chemically Synthesized
augacauuucguuuuuuacacga

SEQ ID NO: 1150 - RNA, 23 nt, Artificial
  Chemically Synthesized
gaugacauuucguuuuuuacacg

SEQ ID NO: 1151 - RNA, 23 nt, Artificial
  Chemically Synthesized
agaugacauuucguuuuuuacac

SEQ ID NO: 1152 - RNA, 23 nt, Artificial
  Chemically Synthesized
cagugucaacacgacaccggaua

SEQ ID NO: 1153 - RNA, 23 nt, Artificial
  Chemically Synthesized
ccagugucaacacgacaccggau

SEQ ID NO: 1154 - RNA, 23 nt, Artificial
  Chemically Synthesized
cguuuuuuacacgagauuucuuu

SEQ ID NO: 1155 - RNA, 23 nt, Artificial
  Chemically Synthesized
ucguuuuuuacacgagauuucuu

SEQ ID NO: 1156 - RNA, 23 nt, Artificial
  Chemically Synthesized
uucguuuuuuacacgagauuucu

SEQ ID NO: 1157 - RNA, 23 nt, Artificial
  Chemically Synthesized
auguucauauuggauugcgccuu

SEQ ID NO: 1158 - RNA, 23 nt, Artificial
  Chemically Synthesized
uauguucauauuggauugcgccu

SEQ ID NO: 1159 - RNA, 23 nt, Artificial
  Chemically Synthesized
auauguucauauuggauugcgcc

SEQ ID NO: 1160 - RNA, 23 nt, Artificial
  Chemically Synthesized
uauauguucauauuggauugcgc

SEQ ID NO: 1161 - RNA, 23 nt, Artificial
  Chemically Synthesized
ugauuaagugguuacuuuguguu

SEQ ID NO: 1162 - RNA, 23 nt, Artificial
  Chemically Synthesized
uugauuaagugguuacuuugugu

SEQ ID NO: 1163 - RNA, 23 nt, Artificial
  Chemically Synthesized
uuugauuaagugguuacuuugug

SEQ ID NO: 1164 - RNA, 23 nt, Artificial
  Chemically Synthesized
uuuugauuaagugguuacuuugu

SEQ ID NO: 1165 - RNA, 23 nt, Artificial
  Chemically Synthesized
uuuuugauuaagugguuacuuug

SEQ ID NO: 1166 - RNA, 23 nt, Artificial
  Chemically Synthesized
gcuacugaucaccaaguagccac

SEQ ID NO: 1167 - RNA, 23 nt, Artificial
  Chemically Synthesized
gugcugauaacagcggaaucccc

SEQ ID NO: 1168 - RNA, 23 nt, Artificial
  Chemically Synthesized
auucuuuuucgugaagaacucca

SEQ ID NO: 1169 - RNA, 23 nt, Artificial
  Chemically Synthesized
aauucuuuuucgugaagaacucc

SEQ ID NO: 1170 - RNA, 23 nt, Artificial
  Chemically Synthesized
aaauucuuuuucgugaagaacuc

SEQ ID NO: 1171 - RNA, 23 nt, Artificial
  Chemically Synthesized
uguuuggaggcuuccagguggua

SEQ ID NO: 1172 - RNA, 23 nt, Artificial
  Chemically Synthesized
guguuuggaggcuuccagguggu

SEQ ID NO: 1173 - RNA, 23 nt, Artificial
  Chemically Synthesized
gguguuuggaggcuuccaggugg

SEQ ID NO: 1174 - RNA, 23 nt, Artificial
  Chemically Synthesized
uuacuuuuuguagagagagcugu

SEQ ID NO: 1175 - RNA, 23 nt, Artificial
  Chemically Synthesized
gcucugaagaaagauagcucgcg

SEQ ID NO: 1176 - RNA, 23 nt, Artificial
  Chemically Synthesized
ugcucugaagaaagauagcucgc

SEQ ID NO: 1177 - RNA, 23 nt, Artificial
  Chemically Synthesized
augcucugaagaaagauagcucg

SEQ ID NO: 1178 - RNA, 23 nt, Artificial
  Chemically Synthesized
guuuuuuacacgagauuucuuuu

SEQ ID NO: 1179 - RNA, 23 nt, Artificial
  Chemically Synthesized
uaaacccucagcacuugcucagu

SEQ ID NO: 1180 - RNA, 23 nt, Artificial
  Chemically Synthesized
aauaaacccucagcacuugcuca

SEQ ID NO: 1181 - RNA, 23 nt, Artificial
  Chemically Synthesized
uguauuauaaaagcucagaugac

SEQ ID NO: 1182 - RNA, 23 nt, Artificial
  Chemically Synthesized
ugcuuuccucauucccaacgggg

SEQ ID NO: 1183 - RNA, 23 nt, Artificial
  Chemically Synthesized
gacuuuuuugauuaagugguuac

SEQ ID NO: 1184 - RNA, 23 nt, Artificial
  Chemically Synthesized
ggcggcuaagguguuuggaggcu

SEQ ID NO: 1185 - RNA, 23 nt, Artificial
  Chemically Synthesized
agggcguuaauaccgaggugcgc

SEQ ID NO: 1186 - RNA, 23 nt, Artificial
  Chemically Synthesized
gagggcguuaauaccgaggugcg

SEQ ID NO: 1187 - RNA, 23 nt, Artificial
  Chemically Synthesized
cgagggcguuaauaccgaggugc

SEQ ID NO: 1188 - RNA, 23 nt, Artificial
  Chemically Synthesized
gcgagggcguuaauaccgaggug

SEQ ID NO: 1189 - RNA, 23 nt, Artificial
  Chemically Synthesized
ugcgagggcguuaauaccgaggu

SEQ ID NO: 1190 - RNA, 23 nt, Artificial
  Chemically Synthesized
ugagcacagacccaagugugcug

SEQ ID NO: 1191 - RNA, 23 nt, Artificial
  Chemically Synthesized
cugagcacagacccaagugugcu

SEQ ID NO: 1192 - RNA, 23 nt, Artificial
  Chemically Synthesized
gcugagcacagacccaagugugc

SEQ ID NO: 1193 - RNA, 23 nt, Artificial
  Chemically Synthesized
cgcugagcacagacccaagugug

SEQ ID NO: 1194 - RNA, 23 nt, Artificial
  Chemically Synthesized
gcgcugagcacagacccaagugu

SEQ ID NO: 1195 - RNA, 23 nt, Artificial
  Chemically Synthesized
ggagaaaaauuccucguccccgg

SEQ ID NO: 1196 - RNA, 23 nt, Artificial
  Chemically Synthesized
uggagaaaaauuccucguccccg

SEQ ID NO: 1197 - RNA, 23 nt, Artificial
  Chemically Synthesized
auggagaaaaauuccucgucccc

SEQ ID NO: 1198 - RNA, 23 nt, Artificial
  Chemically Synthesized
aauggagaaaaauuccucguccc

SEQ ID NO: 1199 - RNA, 23 nt, Artificial
  Chemically Synthesized
uaauggagaaaaauuccucgucc

SEQ ID NO: 1200 - RNA, 23 nt, Artificial
  Chemically Synthesized
gcauuccaagcuggagaaggcgg

SEQ ID NO: 1201 - RNA, 23 nt, Artificial
  Chemically Synthesized
gccuuuguauuauaaaagcucag

SEQ ID NO: 1202 - RNA, 23 nt, Artificial
  Chemically Synthesized
accucucuccuugguccuggaac

SEQ ID NO: 1203 - RNA, 23 nt, Artificial
  Chemically Synthesized
uaccucucuccuugguccuggaa

SEQ ID NO: 1204 - RNA, 23 nt, Artificial
  Chemically Synthesized
gaucaaugccaugaccuaccccg

SEQ ID NO: 1205 - RNA, 23 nt, Artificial
  Chemically Synthesized
agcaagaauaaaugaaagucuga

SEQ ID NO: 1206 - RNA, 23 nt, Artificial
  Chemically Synthesized
ugcugauaacagcggaauccccc

SEQ ID NO: 1207 - RNA, 23 nt, Artificial
  Chemically Synthesized
gagaaaaauuccucguccccggu

SEQ ID NO: 1208 - RNA, 23 nt, Artificial
  Chemically Synthesized
uaaaauaucuuccuuuggggaag

SEQ ID NO: 1209 - RNA, 23 nt, Artificial
  Chemically Synthesized
uuaaaauaucuuccuuuggggaa

SEQ ID NO: 1210 - RNA, 23 nt, Artificial
  Chemically Synthesized
cuuaaaauaucuuccuuugggga

SEQ ID NO: 1211 - RNA, 23 nt, Artificial
  Chemically Synthesized
ucuuaaaauaucuuccuuugggg

SEQ ID NO: 1212 - RNA, 23 nt, Artificial
  Chemically Synthesized
cucuuaaaauaucuuccuuuggg

SEQ ID NO: 1213 - RNA, 23 nt, Artificial
  Chemically Synthesized
cauuccaagcuggagaaggcgga

SEQ ID NO: 1214 - RNA, 23 nt, Artificial
  Chemically Synthesized
auaauggagaaaaauuccucguc

SEQ ID NO: 1215 - RNA, 23 nt, Artificial
  Chemically Synthesized
uauaauggagaaaaauuccucgu

SEQ ID NO: 1216 - RNA, 23 nt, Artificial
  Chemically Synthesized
gucuaccucucuccuugguccug

SEQ ID NO: 1217 - RNA, 23 nt, Artificial
  Chemically Synthesized
cgucuaccucucuccuugguccu

SEQ ID NO: 1218 - RNA, 23 nt, Artificial
  Chemically Synthesized
ccgucuaccucucuccuuggucc

SEQ ID NO: 1219 - RNA, 23 nt, Artificial
  Chemically Synthesized
cccgucuaccucucuccuugguc

SEQ ID NO: 1220 - RNA, 23 nt, Artificial
  Chemically Synthesized
ccccgucuaccucucuccuuggu

SEQ ID NO: 1221 - RNA, 23 nt, Artificial
  Chemically Synthesized
aaaaugcucuuaaaauaucuucc

SEQ ID NO: 1222 - RNA, 23 nt, Artificial
  Chemically Synthesized
ucaaugccaugaccuaccccggg

SEQ ID NO: 1223 - RNA, 23 nt, Artificial
  Chemically Synthesized
aucaaugccaugaccuaccccgg

SEQ ID NO: 1224 - RNA, 23 nt, Artificial
  Chemically Synthesized
auuccaagcuggagaaggcggac

SEQ ID NO: 1225 - RNA, 23 nt, Artificial
  Chemically Synthesized
auauaauggagaaaaauuccucg

SEQ ID NO: 1226 - RNA, 23 nt, Artificial
  Chemically Synthesized
aaaauucuuuuucgugaagaacu

SEQ ID NO: 1227 - RNA, 23 nt, Artificial
  Chemically Synthesized
acaaaauauaauaaacccucagc

SEQ ID NO: 1228 - RNA, 23 nt, Artificial
  Chemically Synthesized
cuuuccucauucccaacggggcc

SEQ ID NO: 1229 - RNA, 23 nt, Artificial
  Chemically Synthesized
gcuuuccucauucccaacggggc

SEQ ID NO: 1230 - RNA, 23 nt, Artificial
  Chemically Synthesized
gauauaauggagaaaaauuccuc

SEQ ID NO: 1231 - RNA, 23 nt, Artificial
  Chemically Synthesized
gcugauaacagcggaaucccccg

SEQ ID NO: 1232 - RNA, 23 nt, Artificial
  Chemically Synthesized
uuaauaccgaggugcgcacucgg

SEQ ID NO: 1233 - RNA, 23 nt, Artificial
  Chemically Synthesized
cugauaacagcggaaucccccgu

SEQ ID NO: 1234 - RNA, 23 nt, Artificial
  Chemically Synthesized
uaauaccgaggugcgcacucggc

SEQ ID NO: 1235 - RNA, 23 nt, Artificial
  Chemically Synthesized
aaaaauucuuuuucgugaagaac

SEQ ID NO: 1236 - RNA, 23 nt, Artificial
  Chemically Synthesized
uuuccucauucccaacggggccu

SEQ ID NO: 1237 - RNA, 23 nt, Artificial
  Chemically Synthesized
cuaccucucuccuugguccugga

SEQ ID NO: 1238 - RNA, 23 nt, Artificial
  Chemically Synthesized
ucuaccucucuccuugguccugg

SEQ ID NO: 1239 - RNA, 23 nt, Artificial
  Chemically Synthesized
uuauauguucauauuggauugcg

SEQ ID NO: 1240 - RNA, 23 nt, Artificial
  Chemically Synthesized
augacagugaagcaccuccggaa

SEQ ID NO: 1241 - RNA, 23 nt, Artificial
  Chemically Synthesized
aaugacagugaagcaccuccgga

SEQ ID NO: 1242 - RNA, 23 nt, Artificial
  Chemically Synthesized
agauuucuuuuuuaugugaugcc

SEQ ID NO: 1243 - RNA, 23 nt, Artificial
  Chemically Synthesized
uuuauauguucauauuggauugc

SEQ ID NO: 1244 - RNA, 23 nt, Artificial
  Chemically Synthesized
gcuucacugucauuuccagaaug

SEQ ID NO: 1245 - RNA, 23 nt, Artificial
  Chemically Synthesized
cuucacugucauuuccagaaugu

SEQ ID NO: 1246 - RNA, 23 nt, Artificial
  Chemically Synthesized
uucacugucauuuccagaauguc

SEQ ID NO: 1247 - RNA, 23 nt, Artificial
  Chemically Synthesized
ucagagcauccaaaaucaguguu

SEQ ID NO: 1248 - RNA, 23 nt, Artificial
  Chemically Synthesized
cagagcauccaaaaucaguguuu

SEQ ID NO: 1249 - RNA, 23 nt, Artificial
  Chemically Synthesized
agagcauccaaaaucaguguuuu

SEQ ID NO: 1250 - RNA, 23 nt, Artificial
  Chemically Synthesized
gugcauggucagucacuuaauac

SEQ ID NO: 1251 - RNA, 23 nt, Artificial
  Chemically Synthesized
ugcauggucagucacuuaauaca

SEQ ID NO: 1252 - RNA, 23 nt, Artificial
  Chemically Synthesized
gcauggucagucacuuaauacag

SEQ ID NO: 1253 - RNA, 23 nt, Artificial
  Chemically Synthesized
cauggucagucacuuaauacagc

SEQ ID NO: 1254 - RNA, 23 nt, Artificial
  Chemically Synthesized
auggucagucacuuaauacagcu

SEQ ID NO: 1255 - RNA, 23 nt, Artificial
  Chemically Synthesized
gaugacuuucugugcucagaugc

SEQ ID NO: 1256 - RNA, 23 nt, Artificial
  Chemically Synthesized
augacuuucugugcucagaugcu

SEQ ID NO: 1257 - RNA, 23 nt, Artificial
  Chemically Synthesized
uucugugcucagaugcugucuuu

SEQ ID NO: 1258 - RNA, 23 nt, Artificial
  Chemically Synthesized
auuuuauuuuuggaguucuucac

SEQ ID NO: 1259 - RNA, 23 nt, Artificial
  Chemically Synthesized
uuuuggaguucuucacgaaaaag

SEQ ID NO: 1260 - RNA, 23 nt, Artificial
  Chemically Synthesized
uuuggaguucuucacgaaaaaga

SEQ ID NO: 1261 - RNA, 23 nt, Artificial
  Chemically Synthesized
gggguaggucauggcauugaucu

SEQ ID NO: 1262 - RNA, 23 nt, Artificial
  Chemically Synthesized
ggguaggucauggcauugaucug

SEQ ID NO: 1263 - RNA, 23 nt, Artificial
  Chemically Synthesized
gguaggucauggcauugaucugg

SEQ ID NO: 1264 - RNA, 23 nt, Artificial
  Chemically Synthesized
guaggucauggcauugaucuggg

SEQ ID NO: 1265 - RNA, 23 nt, Artificial
  Chemically Synthesized
uaggucauggcauugaucugggu

SEQ ID NO: 1266 - RNA, 23 nt, Artificial
  Chemically Synthesized
cagcuuggaaugccgcgagcuau

SEQ ID NO: 1267 - RNA, 23 nt, Artificial
  Chemically Synthesized
agcuuggaaugccgcgagcuauc

SEQ ID NO: 1268 - RNA, 23 nt, Artificial
  Chemically Synthesized
gcuuggaaugccgcgagcuaucu

SEQ ID NO: 1269 - RNA, 23 nt, Artificial
  Chemically Synthesized
cuuggaaugccgcgagcuaucuu

SEQ ID NO: 1270 - RNA, 23 nt, Artificial
  Chemically Synthesized
uuggaaugccgcgagcuaucuuu

SEQ ID NO: 1271 - RNA, 23 nt, Artificial
  Chemically Synthesized
uggcuacuuggugaucaguagcg

SEQ ID NO: 1272 - RNA, 23 nt, Artificial
  Chemically Synthesized
ggcuacuuggugaucaguagcgc

SEQ ID NO: 1273 - RNA, 23 nt, Artificial
  Chemically Synthesized
gcuacuuggugaucaguagcgcu

SEQ ID NO: 1274 - RNA, 23 nt, Artificial
  Chemically Synthesized
uuucagcuggcucagacuuucau

SEQ ID NO: 1275 - RNA, 23 nt, Artificial
  Chemically Synthesized
uucagcuggcucagacuuucauu

SEQ ID NO: 1276 - RNA, 23 nt, Artificial
  Chemically Synthesized
ucagcuggcucagacuuucauuu

SEQ ID NO: 1277 - RNA, 23 nt, Artificial
  Chemically Synthesized
gaggugcuucacugucauuucca

SEQ ID NO: 1278 - RNA, 23 nt, Artificial
  Chemically Synthesized
aggugcuucacugucauuuccag

SEQ ID NO: 1279 - RNA, 23 nt, Artificial
  Chemically Synthesized
ggugcuucacugucauuuccaga

SEQ ID NO: 1280 - RNA, 23 nt, Artificial
  Chemically Synthesized
ucaaguuccuguuuagaguccgg

SEQ ID NO: 1281 - RNA, 23 nt, Artificial
  Chemically Synthesized
ugggaaugaggaaagcaaacugg

SEQ ID NO: 1282 - RNA, 23 nt, Artificial
  Chemically Synthesized
uccgcuguuaucagcaccagcuc

SEQ ID NO: 1283 - RNA, 23 nt, Artificial
  Chemically Synthesized
uggugaucaguagcgcuguucca

SEQ ID NO: 1284 - RNA, 23 nt, Artificial
  Chemically Synthesized
auauauacaaauauagugcaugg

SEQ ID NO: 1285 - RNA, 23 nt, Artificial
  Chemically Synthesized
uauauacaaauauagugcauggu

SEQ ID NO: 1286 - RNA, 23 nt, Artificial
  Chemically Synthesized
auauacaaauauagugcaugguc

SEQ ID NO: 1287 - RNA, 23 nt, Artificial
  Chemically Synthesized
uauacaaauauagugcaugguca

SEQ ID NO: 1288 - RNA, 23 nt, Artificial
  Chemically Synthesized
auacaaauauagugcauggucag

SEQ ID NO: 1289 - RNA, 23 nt, Artificial
  Chemically Synthesized
ccaaaaucaguguuuucagcugg

SEQ ID NO: 1290 - RNA, 23 nt, Artificial
  Chemically Synthesized
caaaaucaguguuuucagcuggc

SEQ ID NO: 1291 - RNA, 23 nt, Artificial
  Chemically Synthesized
aaaaucaguguuuucagcuggcu

SEQ ID NO: 1292 - RNA, 23 nt, Artificial
  Chemically Synthesized
uuucaaacaucuuuggcaucaca

SEQ ID NO: 1293 - RNA, 23 nt, Artificial
  Chemically Synthesized
uucaaacaucuuuggcaucacau

SEQ ID NO: 1294 - RNA, 23 nt, Artificial
  Chemically Synthesized
ucaaacaucuuuggcaucacaua

SEQ ID NO: 1295 - RNA, 23 nt, Artificial
  Chemically Synthesized
aauacagcucucucuacaaaaag

SEQ ID NO: 1296 - RNA, 23 nt, Artificial
  Chemically Synthesized
auacagcucucucuacaaaaagu

SEQ ID NO: 1297 - RNA, 23 nt, Artificial
  Chemically Synthesized
uacagcucucucuacaaaaagua

SEQ ID NO: 1298 - RNA, 23 nt, Artificial
  Chemically Synthesized
uggaaugccgcgagcuaucuuuc

SEQ ID NO: 1299 - RNA, 23 nt, Artificial
  Chemically Synthesized
ggaaugccgcgagcuaucuuucu

SEQ ID NO: 1300 - RNA, 23 nt, Artificial
  Chemically Synthesized
gaaugccgcgagcuaucuuucuu

SEQ ID NO: 1301 - RNA, 23 nt, Artificial
  Chemically Synthesized
aaugccgcgagcuaucuuucuuc

SEQ ID NO: 1302 - RNA, 23 nt, Artificial
  Chemically Synthesized
augccgcgagcuaucuuucuuca

SEQ ID NO: 1303 - RNA, 23 nt, Artificial
  Chemically Synthesized
uggucagucacuuaauacagcuc

SEQ ID NO: 1304 - RNA, 23 nt, Artificial
  Chemically Synthesized
ggucagucacuuaauacagcucu

SEQ ID NO: 1305 - RNA, 23 nt, Artificial
  Chemically Synthesized
gucagucacuuaauacagcucuc

SEQ ID NO: 1306 - RNA, 23 nt, Artificial
  Chemically Synthesized
ucagucacuuaauacagcucucu

SEQ ID NO: 1307 - RNA, 23 nt, Artificial
  Chemically Synthesized
agucacuuaauacagcucucucu

SEQ ID NO: 1308 - RNA, 23 nt, Artificial
  Chemically Synthesized
gucacuuaauacagcucucucua

SEQ ID NO: 1309 - RNA, 23 nt, Artificial
  Chemically Synthesized
ccauaauaggcuuugaugacuuu

SEQ ID NO: 1310 - RNA, 23 nt, Artificial
  Chemically Synthesized
ugucucuuuuacuugagacuuuc

SEQ ID NO: 1311 - RNA, 23 nt, Artificial
  Chemically Synthesized
gucucuuuuacuugagacuuuca

SEQ ID NO: 1312 - RNA, 23 nt, Artificial
  Chemically Synthesized
uacuugagacuuucacaaaacua

SEQ ID NO: 1313 - RNA, 23 nt, Artificial
  Chemically Synthesized
acuugagacuuucacaaaacuac

SEQ ID NO: 1314 - RNA, 23 nt, Artificial
  Chemically Synthesized
cuugagacuuucacaaaacuacu

SEQ ID NO: 1315 - RNA, 23 nt, Artificial
  Chemically Synthesized
uugagacuuucacaaaacuacug

SEQ ID NO: 1316 - RNA, 23 nt, Artificial
  Chemically Synthesized
cagucacuuaauacagcucucuc

SEQ ID NO: 1317 - RNA, 23 nt, Artificial
  Chemically Synthesized
acuuaaucaaaaaaguccucuuc

SEQ ID NO: 1318 - RNA, 23 nt, Artificial
  Chemically Synthesized
caaguuccuguuuagaguccgga

SEQ ID NO: 1319 - RNA, 23 nt, Artificial
  Chemically Synthesized
aaguuccuguuuagaguccggag

SEQ ID NO: 1320 - RNA, 23 nt, Artificial
  Chemically Synthesized
aguuccuguuuagaguccggagg

SEQ ID NO: 1321 - RNA, 23 nt, Artificial
  Chemically Synthesized
guuccuguuuagaguccggaggg

SEQ ID NO: 1322 - RNA, 23 nt, Artificial
  Chemically Synthesized
uuccuguuuagaguccggaggga

SEQ ID NO: 1323 - RNA, 23 nt, Artificial
  Chemically Synthesized
uggcauugaucugggucaugcag

SEQ ID NO: 1324 - RNA, 23 nt, Artificial
  Chemically Synthesized
gcucuucgucuuuucuccauaau

SEQ ID NO: 1325 - RNA, 23 nt, Artificial
  Chemically Synthesized
cucuucgucuuuucuccauaaua

SEQ ID NO: 1326 - RNA, 23 nt, Artificial
  Chemically Synthesized
ucuucgucuuuucuccauaauag

SEQ ID NO: 1327 - RNA, 23 nt, Artificial
  Chemically Synthesized
cuucgucuuuucuccauaauagg

SEQ ID NO: 1328 - RNA, 23 nt, Artificial
  Chemically Synthesized
aauacaaaggcgcaauccaauau

SEQ ID NO: 1329 - RNA, 23 nt, Artificial
  Chemically Synthesized
auacaaaggcgcaauccaauaug

SEQ ID NO: 1330 - RNA, 23 nt, Artificial
  Chemically Synthesized
uacaaaggcgcaauccaauauga

SEQ ID NO: 1331 - RNA, 23 nt, Artificial
  Chemically Synthesized
uauagugcauggucagucacuua

SEQ ID NO: 1332 - RNA, 23 nt, Artificial
  Chemically Synthesized
auagugcauggucagucacuuaa

SEQ ID NO: 1333 - RNA, 23 nt, Artificial
  Chemically Synthesized
uagugcauggucagucacuuaau

SEQ ID NO: 1334 - RNA, 23 nt, Artificial
  Chemically Synthesized
agugcauggucagucacuuaaua

SEQ ID NO: 1335 - RNA, 23 nt, Artificial
  Chemically Synthesized
aaccacuuaaucaaaaaaguccu

SEQ ID NO: 1336 - RNA, 23 nt, Artificial
  Chemically Synthesized
accacuuaaucaaaaaaguccuc

SEQ ID NO: 1337 - RNA, 23 nt, Artificial
  Chemically Synthesized
ccacuuaaucaaaaaaguccucu

SEQ ID NO: 1338 - RNA, 23 nt, Artificial
  Chemically Synthesized
cacuuaaucaaaaaaguccucuu

SEQ ID NO: 1339 - RNA, 23 nt, Artificial
  Chemically Synthesized
uuagaguccggagggaagagagg

SEQ ID NO: 1340 - RNA, 23 nt, Artificial
  Chemically Synthesized
gugcucagaugcugucuuugguu

SEQ ID NO: 1341 - RNA, 23 nt, Artificial
  Chemically Synthesized
ugcucagaugcugucuuugguuu

SEQ ID NO: 1342 - RNA, 23 nt, Artificial
  Chemically Synthesized
gcucagaugcugucuuugguuua

SEQ ID NO: 1343 - RNA, 23 nt, Artificial
  Chemically Synthesized
cucagaugcugucuuugguuuau

SEQ ID NO: 1344 - RNA, 23 nt, Artificial
  Chemically Synthesized
ucagaugcugucuuugguuuauc

SEQ ID NO: 1345 - RNA, 23 nt, Artificial
  Chemically Synthesized
uacaaauauagugcauggucagu

SEQ ID NO: 1346 - RNA, 23 nt, Artificial
  Chemically Synthesized
cuccauuauaucagcuggcauuu

SEQ ID NO: 1347 - RNA, 23 nt, Artificial
  Chemically Synthesized
uccauuauaucagcuggcauuuu

SEQ ID NO: 1348 - RNA, 23 nt, Artificial
  Chemically Synthesized
guccucuucucucccaguauuca

SEQ ID NO: 1349 - RNA, 23 nt, Artificial
  Chemically Synthesized
uccucuucucucccaguauucaa

SEQ ID NO: 1350 - RNA, 23 nt, Artificial
  Chemically Synthesized
ccaguauucaaguuccuguuuag

SEQ ID NO: 1351 - RNA, 23 nt, Artificial
  Chemically Synthesized
caguauucaaguuccuguuuaga

SEQ ID NO: 1352 - RNA, 23 nt, Artificial
  Chemically Synthesized
ugagacuuucacaaaacuacuga

SEQ ID NO: 1353 - RNA, 23 nt, Artificial
  Chemically Synthesized
uuuuaagagcauuuucaaacauc

SEQ ID NO: 1354 - RNA, 23 nt, Artificial
  Chemically Synthesized
uuuaagagcauuuucaaacaucu

SEQ ID NO: 1355 - RNA, 23 nt, Artificial
  Chemically Synthesized
uuaagagcauuuucaaacaucuu

SEQ ID NO: 1356 - RNA, 23 nt, Artificial
  Chemically Synthesized
uaagagcauuuucaaacaucuuu

SEQ ID NO: 1357 - RNA, 23 nt, Artificial
  Chemically Synthesized
aagagcauuuucaaacaucuuug

SEQ ID NO: 1358 - RNA, 23 nt, Artificial
  Chemically Synthesized
uuaaaaaaacacaaaguaaccac

SEQ ID NO: 1359 - RNA, 23 nt, Artificial
  Chemically Synthesized
uaaaaaaacacaaaguaaccacu

SEQ ID NO: 1360 - RNA, 23 nt, Artificial
  Chemically Synthesized
aaaaaaacacaaaguaaccacuu

SEQ ID NO: 1361 - RNA, 23 nt, Artificial
  Chemically Synthesized
aaaaaacacaaaguaaccacuua

SEQ ID NO: 1362 - RNA, 23 nt, Artificial
  Chemically Synthesized
aaaaacacaaaguaaccacuuaa

SEQ ID NO: 1363 - RNA, 23 nt, Artificial
  Chemically Synthesized
aaaguccucuucucucccaguau

SEQ ID NO: 1364 - RNA, 23 nt, Artificial
  Chemically Synthesized
aaguccucuucucucccaguauu

SEQ ID NO: 1365 - RNA, 23 nt, Artificial
  Chemically Synthesized
ucgguauuaacgcccucgcacgu

SEQ ID NO: 1366 - RNA, 23 nt, Artificial
  Chemically Synthesized
cgguauuaacgcccucgcacgug

SEQ ID NO: 1367 - RNA, 23 nt, Artificial
  Chemically Synthesized
gguauuaacgcccucgcacgugg

SEQ ID NO: 1368 - RNA, 23 nt, Artificial
  Chemically Synthesized
guauuaacgcccucgcacgugga

SEQ ID NO: 1369 - RNA, 23 nt, Artificial
  Chemically Synthesized
uauuaacgcccucgcacguggac

SEQ ID NO: 1370 - RNA, 23 nt, Artificial
  Chemically Synthesized
gaaaugucaucugagcuuuuaua

SEQ ID NO: 1371 - RNA, 23 nt, Artificial
  Chemically Synthesized
aaaugucaucugagcuuuuauaa

SEQ ID NO: 1372 - RNA, 23 nt, Artificial
  Chemically Synthesized
aaugucaucugagcuuuuauaau

SEQ ID NO: 1373 - RNA, 23 nt, Artificial
  Chemically Synthesized
augucaucugagcuuuuauaaua

SEQ ID NO: 1374 - RNA, 23 nt, Artificial
  Chemically Synthesized
ugucaucugagcuuuuauaauac

SEQ ID NO: 1375 - RNA, 23 nt, Artificial
  Chemically Synthesized
uaaaaaacgaaaugucaucugag

SEQ ID NO: 1376 - RNA, 23 nt, Artificial
  Chemically Synthesized
aaaaaacgaaaugucaucugagc

SEQ ID NO: 1377 - RNA, 23 nt, Artificial
  Chemically Synthesized
aaaaacgaaaugucaucugagcu

SEQ ID NO: 1378 - RNA, 23 nt, Artificial
  Chemically Synthesized
aaaacgaaaugucaucugagcuu

SEQ ID NO: 1379 - RNA, 23 nt, Artificial
  Chemically Synthesized
aaacgaaaugucaucugagcuuu

SEQ ID NO: 1380 - RNA, 23 nt, Artificial
  Chemically Synthesized
gagcauuuucaaacaucuuuggc

SEQ ID NO: 1381 - RNA, 23 nt, Artificial
  Chemically Synthesized
aaacuacugagcaagugcugagg

SEQ ID NO: 1382 - RNA, 23 nt, Artificial
  Chemically Synthesized
aacuacugagcaagugcugaggg

SEQ ID NO: 1383 - RNA, 23 nt, Artificial
  Chemically Synthesized
acuacugagcaagugcugagggu

SEQ ID NO: 1384 - RNA, 23 nt, Artificial
  Chemically Synthesized
cuacugagcaagugcugaggguu

SEQ ID NO: 1385 - RNA, 23 nt, Artificial
  Chemically Synthesized
uacugagcaagugcugaggguuu

SEQ ID NO: 1386 - RNA, 23 nt, Artificial
  Chemically Synthesized
acaaaggcgcaauccaauaugaa

SEQ ID NO: 1387 - RNA, 23 nt, Artificial
  Chemically Synthesized
caaaggcgcaauccaauaugaac

SEQ ID NO: 1388 - RNA, 23 nt, Artificial
  Chemically Synthesized
aaaggcgcaauccaauaugaaca

SEQ ID NO: 1389 - RNA, 23 nt, Artificial
  Chemically Synthesized
gcgcuguuccaggaccaaggaga

SEQ ID NO: 1390 - RNA, 23 nt, Artificial
  Chemically Synthesized
cgcuguuccaggaccaaggagag

SEQ ID NO: 1391 - RNA, 23 nt, Artificial
  Chemically Synthesized
gcuguuccaggaccaaggagaga

SEQ ID NO: 1392 - RNA, 23 nt, Artificial
  Chemically Synthesized
cuguuccaggaccaaggagagag

SEQ ID NO: 1393 - RNA, 23 nt, Artificial
  Chemically Synthesized
uguuccaggaccaaggagagagg

SEQ ID NO: 1394 - RNA, 23 nt, Artificial
  Chemically Synthesized
agagcauuuucaaacaucuuugg

SEQ ID NO: 1395 - RNA, 23 nt, Artificial
  Chemically Synthesized
gaaaucucguguaaaaaacgaaa

SEQ ID NO: 1396 - RNA, 23 nt, Artificial
  Chemically Synthesized
aaaucucguguaaaaaacgaaau

SEQ ID NO: 1397 - RNA, 23 nt, Artificial
  Chemically Synthesized
aaucucguguaaaaaacgaaaug

SEQ ID NO: 1398 - RNA, 23 nt, Artificial
  Chemically Synthesized
aucucguguaaaaaacgaaaugu

SEQ ID NO: 1399 - RNA, 23 nt, Artificial
  Chemically Synthesized
ucucguguaaaaaacgaaauguc

SEQ ID NO: 1400 - RNA, 23 nt, Artificial
  Chemically Synthesized
cucccaguauucaaguuccuguu

SEQ ID NO: 1401 - RNA, 23 nt, Artificial
  Chemically Synthesized
cucguucaugcacucgcugaagc

SEQ ID NO: 1402 - RNA, 23 nt, Artificial
  Chemically Synthesized
ucguucaugcacucgcugaagcc

SEQ ID NO: 1403 - RNA, 23 nt, Artificial
  Chemically Synthesized
cguucaugcacucgcugaagccg

SEQ ID NO: 1404 - RNA, 23 nt, Artificial
  Chemically Synthesized
guucaugcacucgcugaagccgg

SEQ ID NO: 1405 - RNA, 23 nt, Artificial
  Chemically Synthesized
uucaugcacucgcugaagccggc

SEQ ID NO: 1406 - RNA, 23 nt, Artificial
  Chemically Synthesized
gagcauccaaaaucaguguuuuc

SEQ ID NO: 1407 - RNA, 23 nt, Artificial
  Chemically Synthesized
uguaaaaaacgaaaugucaucug

SEQ ID NO: 1408 - RNA, 23 nt, Artificial
  Chemically Synthesized
guaaaaaacgaaaugucaucuga

SEQ ID NO: 1409 - RNA, 23 nt, Artificial
  Chemically Synthesized
aacgaaaugucaucugagcuuuu

SEQ ID NO: 1410 - RNA, 23 nt, Artificial
  Chemically Synthesized
acgaaaugucaucugagcuuuua

SEQ ID NO: 1411 - RNA, 23 nt, Artificial
  Chemically Synthesized
aguccucuucucucccaguauuc

SEQ ID NO: 1412 - RNA, 23 nt, Artificial
  Chemically Synthesized
ucccaguauucaaguuccuguuu

SEQ ID NO: 1413 - RNA, 23 nt, Artificial
  Chemically Synthesized
cccaguauucaaguuccuguuua

SEQ ID NO: 1414 - RNA, 23 nt, Artificial
  Chemically Synthesized
ugaggaaagcaaacuggccaucg

SEQ ID NO: 1415 - RNA, 23 nt, Artificial
  Chemically Synthesized
uuuguggcuacuuggugaucagu

SEQ ID NO: 1416 - RNA, 23 nt, Artificial
  Chemically Synthesized
uuguggcuacuuggugaucagua

SEQ ID NO: 1417 - RNA, 23 nt, Artificial
  Chemically Synthesized
uguggcuacuuggugaucaguag

SEQ ID NO: 1418 - RNA, 23 nt, Artificial
  Chemically Synthesized
ucugugcucagaugcugucuuug

SEQ ID NO: 1419 - RNA, 23 nt, Artificial
  Chemically Synthesized
cugugcucagaugcugucuuugg

SEQ ID NO: 1420 - RNA, 23 nt, Artificial
  Chemically Synthesized
ugugcucagaugcugucuuuggu

SEQ ID NO: 1421 - RNA, 23 nt, Artificial
  Chemically Synthesized
gcugucuuugguuuauccggugu

SEQ ID NO: 1422 - RNA, 23 nt, Artificial
  Chemically Synthesized
cugucuuugguuuauccgguguc

SEQ ID NO: 1423 - RNA, 23 nt, Artificial
  Chemically Synthesized
ugugucucuuuuacuugagacuu

SEQ ID NO: 1424 - RNA, 23 nt, Artificial
  Chemically Synthesized
gugucucuuuuacuugagacuuu

SEQ ID NO: 1425 - RNA, 23 nt, Artificial
  Chemically Synthesized
ccgcuggaaggugacacugcguu

SEQ ID NO: 1426 - RNA, 23 nt, Artificial
  Chemically Synthesized
cgcuggaaggugacacugcguug

SEQ ID NO: 1427 - RNA, 23 nt, Artificial
  Chemically Synthesized
gcuggaaggugacacugcguugg

SEQ ID NO: 1428 - RNA, 23 nt, Artificial
  Chemically Synthesized
cuggaaggugacacugcguuggg

SEQ ID NO: 1429 - RNA, 23 nt, Artificial
  Chemically Synthesized
uggaaggugacacugcguugggg

SEQ ID NO: 1430 - RNA, 23 nt, Artificial
  Chemically Synthesized
aggucauggcauugaucuggguc

SEQ ID NO: 1431 - RNA, 23 nt, Artificial
  Chemically Synthesized
ggucauggcauugaucuggguca

SEQ ID NO: 1432 - RNA, 23 nt, Artificial
  Chemically Synthesized
gucauggcauugaucugggucau

SEQ ID NO: 1433 - RNA, 23 nt, Artificial
  Chemically Synthesized
ucauggcauugaucugggucaug

SEQ ID NO: 1434 - RNA, 23 nt, Artificial
  Chemically Synthesized
cauggcauugaucugggucaugc

SEQ ID NO: 1435 - RNA, 23 nt, Artificial
  Chemically Synthesized
cgggucaccucguucaugcacuc

SEQ ID NO: 1436 - RNA, 23 nt, Artificial
  Chemically Synthesized
gggucaccucguucaugcacucg

SEQ ID NO: 1437 - RNA, 23 nt, Artificial
  Chemically Synthesized
ggucaccucguucaugcacucgc

SEQ ID NO: 1438 - RNA, 23 nt, Artificial
  Chemically Synthesized
gucaccucguucaugcacucgcu

SEQ ID NO: 1439 - RNA, 23 nt, Artificial
  Chemically Synthesized
ucaccucguucaugcacucgcug

SEQ ID NO: 1440 - RNA, 23 nt, Artificial
  Chemically Synthesized
uccagaauguccgccuucuccag

SEQ ID NO: 1441 - RNA, 23 nt, Artificial
  Chemically Synthesized
ugccgcgagcuaucuuucuucag

SEQ ID NO: 1442 - RNA, 23 nt, Artificial
  Chemically Synthesized
ucacaaaacuacugagcaagugc

SEQ ID NO: 1443 - RNA, 23 nt, Artificial
  Chemically Synthesized
cacaaaacuacugagcaagugcu

SEQ ID NO: 1444 - RNA, 23 nt, Artificial
  Chemically Synthesized
acaaaacuacugagcaagugcug

SEQ ID NO: 1445 - RNA, 23 nt, Artificial
  Chemically Synthesized
caaaacuacugagcaagugcuga

SEQ ID NO: 1446 - RNA, 23 nt, Artificial
  Chemically Synthesized
aaaacuacugagcaagugcugag

SEQ ID NO: 1447 - RNA, 23 nt, Artificial
  Chemically Synthesized
cgaaaugucaucugagcuuuuau

SEQ ID NO: 1448 - RNA, 23 nt, Artificial
  Chemically Synthesized
cucucuacaaaaaguaacuucuu

SEQ ID NO: 1449 - RNA, 23 nt, Artificial
  Chemically Synthesized
ucucuacaaaaaguaacuucuua

SEQ ID NO: 1450 - RNA, 23 nt, Artificial
  Chemically Synthesized
cucuacaaaaaguaacuucuuag

SEQ ID NO: 1451 - RNA, 23 nt, Artificial
  Chemically Synthesized
uccuguuuagaguccggagggaa

SEQ ID NO: 1452 - RNA, 23 nt, Artificial
  Chemically Synthesized
aaaucaguguuuucagcuggcuc

SEQ ID NO: 1453 - RNA, 23 nt, Artificial
  Chemically Synthesized
aaucaguguuuucagcuggcuca

SEQ ID NO: 1454 - RNA, 23 nt, Artificial
  Chemically Synthesized
gagacuuucacaaaacuacugag

SEQ ID NO: 1455 - RNA, 23 nt, Artificial
  Chemically Synthesized
auggcauugaucugggucaugca

SEQ ID NO: 1456 - RNA, 23 nt, Artificial
  Chemically Synthesized
gccgcgagcuaucuuucuucaga

SEQ ID NO: 1457 - RNA, 23 nt, Artificial
  Chemically Synthesized
ccgcgagcuaucuuucuucagag

SEQ ID NO: 1458 - RNA, 23 nt, Artificial
  Chemically Synthesized
uuggaguucuucacgaaaaagaa

SEQ ID NO: 1459 - RNA, 23 nt, Artificial
  Chemically Synthesized
aaacaucuuuggcaucacauaaa

SEQ ID NO: 1460 - RNA, 23 nt, Artificial
  Chemically Synthesized
aacaucuuuggcaucacauaaaa

SEQ ID NO: 1461 - RNA, 23 nt, Artificial
  Chemically Synthesized
acaucuuuggcaucacauaaaaa

SEQ ID NO: 1462 - RNA, 23 nt, Artificial
  Chemically Synthesized
caucuuuggcaucacauaaaaaa

SEQ ID NO: 1463 - RNA, 23 nt, Artificial
  Chemically Synthesized
ugagcuuuuauaauacaaaggcg

SEQ ID NO: 1464 - RNA, 23 nt, Artificial
  Chemically Synthesized
gagcaagugcugaggguuuauua

SEQ ID NO: 1465 - RNA, 23 nt, Artificial
  Chemically Synthesized
agcaagugcugaggguuuauuau

SEQ ID NO: 1466 - RNA, 23 nt, Artificial
  Chemically Synthesized
gcaagugcugaggguuuauuaua

SEQ ID NO: 1467 - RNA, 23 nt, Artificial
  Chemically Synthesized
caagugcugaggguuuauuauau

SEQ ID NO: 1468 - RNA, 23 nt, Artificial
  Chemically Synthesized
aagugcugaggguuuauuauauu

SEQ ID NO: 1469 - RNA, 23 nt, Artificial
  Chemically Synthesized
agugcugaggguuuauuauauuu

SEQ ID NO: 1470 - RNA, 23 nt, Artificial
  Chemically Synthesized
gugcugaggguuuauuauauuuu

SEQ ID NO: 1471 - RNA, 23 nt, Artificial
  Chemically Synthesized
ugcugaggguuuauuauauuuug

SEQ ID NO: 1472 - RNA, 23 nt, Artificial
  Chemically Synthesized
cuccaaacaccuuagccgccucu

SEQ ID NO: 1473 - RNA, 23 nt, Artificial
  Chemically Synthesized
uccaaacaccuuagccgccucuc

SEQ ID NO: 1474 - RNA, 23 nt, Artificial
  Chemically Synthesized
ccaaacaccuuagccgccucucc

SEQ ID NO: 1475 - RNA, 23 nt, Artificial
  Chemically Synthesized
caaacaccuuagccgccucucca

SEQ ID NO: 1476 - RNA, 23 nt, Artificial
  Chemically Synthesized
aaacaccuuagccgccucuccag

SEQ ID NO: 1477 - RNA, 23 nt, Artificial
  Chemically Synthesized
ccagaauguccgccuucuccagc

SEQ ID NO: 1478 - RNA, 23 nt, Artificial
  Chemically Synthesized
cagaauguccgccuucuccagcu

SEQ ID NO: 1479 - RNA, 23 nt, Artificial
  Chemically Synthesized
agaauguccgccuucuccagcuu

SEQ ID NO: 1480 - RNA, 23 nt, Artificial
  Chemically Synthesized
caaacaucuuuggcaucacauaa

SEQ ID NO: 1481 - RNA, 23 nt, Artificial
  Chemically Synthesized
caccucguucaugcacucgcuga

SEQ ID NO: 1482 - RNA, 23 nt, Artificial
  Chemically Synthesized
accucguucaugcacucgcugaa

SEQ ID NO: 1483 - RNA, 23 nt, Artificial
  Chemically Synthesized
ccucguucaugcacucgcugaag

SEQ ID NO: 1484 - RNA, 23 nt, Artificial
  Chemically Synthesized
ccggugucguguugacacuggcu

SEQ ID NO: 1485 - RNA, 23 nt, Artificial
  Chemically Synthesized
cggugucguguugacacuggcug

SEQ ID NO: 1486 - RNA, 23 nt, Artificial
  Chemically Synthesized
ggugucguguugacacuggcugg

SEQ ID NO: 1487 - RNA, 23 nt, Artificial
  Chemically Synthesized
gugucguguugacacuggcuggg

SEQ ID NO: 1488 - RNA, 23 nt, Artificial
  Chemically Synthesized
ugucguguugacacuggcugggg

SEQ ID NO: 1489 - RNA, 23 nt, Artificial
  Chemically Synthesized
cuggaagccuccaaacaccuuag

SEQ ID NO: 1490 - RNA, 23 nt, Artificial
  Chemically Synthesized
uggaagccuccaaacaccuuagc

SEQ ID NO: 1491 - RNA, 23 nt, Artificial
  Chemically Synthesized
ggaagccuccaaacaccuuagcc

SEQ ID NO: 1492 - RNA, 23 nt, Artificial
  Chemically Synthesized
gaagccuccaaacaccuuagccg

SEQ ID NO: 1493 - RNA, 23 nt, Artificial
  Chemically Synthesized
aagccuccaaacaccuuagccgc

SEQ ID NO: 1494 - RNA, 23 nt, Artificial
  Chemically Synthesized
gcgggucaccucguucaugcacu

SEQ ID NO: 1495 - RNA, 23 nt, Artificial
  Chemically Synthesized
ccggaggugcuucacugucauuu

SEQ ID NO: 1496 - RNA, 23 nt, Artificial
  Chemically Synthesized
cggaggugcuucacugucauuuc

SEQ ID NO: 1497 - RNA, 23 nt, Artificial
  Chemically Synthesized
ggaggugcuucacugucauuucc

SEQ ID NO: 1498 - RNA, 23 nt, Artificial
  Chemically Synthesized
uggcaucacauaaaaaagaaauc

SEQ ID NO: 1499 - RNA, 23 nt, Artificial
  Chemically Synthesized
aaaacacaaaguaaccacuuaau

SEQ ID NO: 1500 - RNA, 23 nt, Artificial
  Chemically Synthesized
caccuggaagccuccaaacaccu

SEQ ID NO: 1501 - RNA, 23 nt, Artificial
  Chemically Synthesized
accuggaagccuccaaacaccuu

SEQ ID NO: 1502 - RNA, 23 nt, Artificial
  Chemically Synthesized
ccuggaagccuccaaacaccuua

SEQ ID NO: 1503 - RNA, 23 nt, Artificial
  Chemically Synthesized
aucaguguuuucagcuggcucag

SEQ ID NO: 1504 - RNA, 23 nt, Artificial
  Chemically Synthesized
ucaguguuuucagcuggcucaga

SEQ ID NO: 1505 - RNA, 23 nt, Artificial
  Chemically Synthesized
caguguuuucagcuggcucagac

SEQ ID NO: 1506 - RNA, 23 nt, Artificial
  Chemically Synthesized
ccaaaggaagauauuuuaagagc

SEQ ID NO: 1507 - RNA, 23 nt, Artificial
  Chemically Synthesized
caaaggaagauauuuuaagagca

SEQ ID NO: 1508 - RNA, 23 nt, Artificial
  Chemically Synthesized
aaaggaagauauuuuaagagcau

SEQ ID NO: 1509 - RNA, 23 nt, Artificial
  Chemically Synthesized
aaggaagauauuuuaagagcauu

SEQ ID NO: 1510 - RNA, 23 nt, Artificial
  Chemically Synthesized
aggaagauauuuuaagagcauuu

SEQ ID NO: 1511 - RNA, 23 nt, Artificial
  Chemically Synthesized
gaggaaagcaaacuggccaucgg

SEQ ID NO: 1512 - RNA, 23 nt, Artificial
  Chemically Synthesized
aggaaagcaaacuggccaucggg

SEQ ID NO: 1513 - RNA, 23 nt, Artificial
  Chemically Synthesized
ggaaagcaaacuggccaucggga

SEQ ID NO: 1514 - RNA, 23 nt, Artificial
  Chemically Synthesized
gaaagcaaacuggccaucgggag

SEQ ID NO: 1515 - RNA, 23 nt, Artificial
  Chemically Synthesized
aaagcaaacuggccaucgggagc

SEQ ID NO: 1516 - RNA, 23 nt, Artificial
  Chemically Synthesized
cgagugcgcaccucgguauuaac

SEQ ID NO: 1517 - RNA, 23 nt, Artificial
  Chemically Synthesized
gagugcgcaccucgguauuaacg

SEQ ID NO: 1518 - RNA, 23 nt, Artificial
  Chemically Synthesized
agugcgcaccucgguauuaacgc

SEQ ID NO: 1519 - RNA, 23 nt, Artificial
  Chemically Synthesized
gugcgcaccucgguauuaacgcc

SEQ ID NO: 1520 - RNA, 23 nt, Artificial
  Chemically Synthesized
ugcgcaccucgguauuaacgccc

SEQ ID NO: 1521 - RNA, 23 nt, Artificial
  Chemically Synthesized
aaacacaaaguaaccacuuaauc

SEQ ID NO: 1522 - RNA, 23 nt, Artificial
  Chemically Synthesized
cagcuggcucagacuuucauuua

SEQ ID NO: 1523 - RNA, 23 nt, Artificial
  Chemically Synthesized
agcuggcucagacuuucauuuau

SEQ ID NO: 1524 - RNA, 23 nt, Artificial
  Chemically Synthesized
gcuggcucagacuuucauuuauu

SEQ ID NO: 1525 - RNA, 23 nt, Artificial
  Chemically Synthesized
cuggcucagacuuucauuuauuc

SEQ ID NO: 1526 - RNA, 23 nt, Artificial
  Chemically Synthesized
uggcucagacuuucauuuauucu

SEQ ID NO: 1527 - RNA, 23 nt, Artificial
  Chemically Synthesized
ggcucagacuuucauuuauucuu

SEQ ID NO: 1528 - RNA, 23 nt, Artificial
  Chemically Synthesized
gcucagacuuucauuuauucuug

SEQ ID NO: 1529 - RNA, 23 nt, Artificial
  Chemically Synthesized
cucagacuuucauuuauucuugc

SEQ ID NO: 1530 - RNA, 23 nt, Artificial
  Chemically Synthesized
ugaugacuuucugugcucagaug

SEQ ID NO: 1531 - RNA, 23 nt, Artificial
  Chemically Synthesized
cucguguaaaaaacgaaauguca

SEQ ID NO: 1532 - RNA, 23 nt, Artificial
  Chemically Synthesized
ucguguaaaaaacgaaaugucau

SEQ ID NO: 1533 - RNA, 23 nt, Artificial
  Chemically Synthesized
cguguaaaaaacgaaaugucauc

SEQ ID NO: 1534 - RNA, 23 nt, Artificial
  Chemically Synthesized
guguaaaaaacgaaaugucaucu

SEQ ID NO: 1535 - RNA, 23 nt, Artificial
  Chemically Synthesized
uauccggugucguguugacacug

SEQ ID NO: 1536 - RNA, 23 nt, Artificial
  Chemically Synthesized
auccggugucguguugacacugg

SEQ ID NO: 1537 - RNA, 23 nt, Artificial
  Chemically Synthesized
aaagaaaucucguguaaaaaacg

SEQ ID NO: 1538 - RNA, 23 nt, Artificial
  Chemically Synthesized
aagaaaucucguguaaaaaacga

SEQ ID NO: 1539 - RNA, 23 nt, Artificial
  Chemically Synthesized
agaaaucucguguaaaaaacgaa

SEQ ID NO: 1540 - RNA, 23 nt, Artificial
  Chemically Synthesized
aaggcgcaauccaauaugaacau

SEQ ID NO: 1541 - RNA, 23 nt, Artificial
  Chemically Synthesized
aggcgcaauccaauaugaacaua

SEQ ID NO: 1542 - RNA, 23 nt, Artificial
  Chemically Synthesized
ggcgcaauccaauaugaacauau

SEQ ID NO: 1543 - RNA, 23 nt, Artificial
  Chemically Synthesized
gcgcaauccaauaugaacauaua

SEQ ID NO: 1544 - RNA, 23 nt, Artificial
  Chemically Synthesized
aacacaaaguaaccacuuaauca

SEQ ID NO: 1545 - RNA, 23 nt, Artificial
  Chemically Synthesized
acacaaaguaaccacuuaaucaa

SEQ ID NO: 1546 - RNA, 23 nt, Artificial
  Chemically Synthesized
cacaaaguaaccacuuaaucaaa

SEQ ID NO: 1547 - RNA, 23 nt, Artificial
  Chemically Synthesized
acaaaguaaccacuuaaucaaaa

SEQ ID NO: 1548 - RNA, 23 nt, Artificial
  Chemically Synthesized
caaaguaaccacuuaaucaaaaa

SEQ ID NO: 1549 - RNA, 23 nt, Artificial
  Chemically Synthesized
guggcuacuuggugaucaguagc

SEQ ID NO: 1550 - RNA, 23 nt, Artificial
  Chemically Synthesized
ggggauuccgcuguuaucagcac

SEQ ID NO: 1551 - RNA, 23 nt, Artificial
  Chemically Synthesized
uggaguucuucacgaaaaagaau

SEQ ID NO: 1552 - RNA, 23 nt, Artificial
  Chemically Synthesized
ggaguucuucacgaaaaagaauu

SEQ ID NO: 1553 - RNA, 23 nt, Artificial
  Chemically Synthesized
gaguucuucacgaaaaagaauuu

SEQ ID NO: 1554 - RNA, 23 nt, Artificial
  Chemically Synthesized
uaccaccuggaagccuccaaaca

SEQ ID NO: 1555 - RNA, 23 nt, Artificial
  Chemically Synthesized
accaccuggaagccuccaaacac

SEQ ID NO: 1556 - RNA, 23 nt, Artificial
  Chemically Synthesized
ccaccuggaagccuccaaacacc

SEQ ID NO: 1557 - RNA, 23 nt, Artificial
  Chemically Synthesized
acagcucucucuacaaaaaguaa

SEQ ID NO: 1558 - RNA, 23 nt, Artificial
  Chemically Synthesized
cgcgagcuaucuuucuucagagc

SEQ ID NO: 1559 - RNA, 23 nt, Artificial
  Chemically Synthesized
gcgagcuaucuuucuucagagca

SEQ ID NO: 1560 - RNA, 23 nt, Artificial
  Chemically Synthesized
cgagcuaucuuucuucagagcau

SEQ ID NO: 1561 - RNA, 23 nt, Artificial
  Chemically Synthesized
aaaagaaaucucguguaaaaaac

SEQ ID NO: 1562 - RNA, 23 nt, Artificial
  Chemically Synthesized
acugagcaagugcugaggguuua

SEQ ID NO: 1563 - RNA, 23 nt, Artificial
  Chemically Synthesized
ugagcaagugcugaggguuuauu

SEQ ID NO: 1564 - RNA, 23 nt, Artificial
  Chemically Synthesized
gucaucugagcuuuuauaauaca

SEQ ID NO: 1565 - RNA, 23 nt, Artificial
  Chemically Synthesized
ccccguugggaaugaggaaagca

SEQ ID NO: 1566 - RNA, 23 nt, Artificial
  Chemically Synthesized
guaaccacuuaaucaaaaaaguc

SEQ ID NO: 1567 - RNA, 23 nt, Artificial
  Chemically Synthesized
agccuccaaacaccuuagccgcc

SEQ ID NO: 1568 - RNA, 23 nt, Artificial
  Chemically Synthesized
gcgcaccucgguauuaacgcccu

SEQ ID NO: 1569 - RNA, 23 nt, Artificial
  Chemically Synthesized
cgcaccucgguauuaacgcccuc

SEQ ID NO: 1570 - RNA, 23 nt, Artificial
  Chemically Synthesized
gcaccucgguauuaacgcccucg

SEQ ID NO: 1571 - RNA, 23 nt, Artificial
  Chemically Synthesized
caccucgguauuaacgcccucgc

SEQ ID NO: 1572 - RNA, 23 nt, Artificial
  Chemically Synthesized
accucgguauuaacgcccucgca

SEQ ID NO: 1573 - RNA, 23 nt, Artificial
  Chemically Synthesized
cagcacacuugggucugugcuca

SEQ ID NO: 1574 - RNA, 23 nt, Artificial
  Chemically Synthesized
agcacacuugggucugugcucag

SEQ ID NO: 1575 - RNA, 23 nt, Artificial
  Chemically Synthesized
gcacacuugggucugugcucagc

SEQ ID NO: 1576 - RNA, 23 nt, Artificial
  Chemically Synthesized
cacacuugggucugugcucagcg

SEQ ID NO: 1577 - RNA, 23 nt, Artificial
  Chemically Synthesized
acacuugggucugugcucagcgc

SEQ ID NO: 1578 - RNA, 23 nt, Artificial
  Chemically Synthesized
ccggggacgaggaauuuuucucc

SEQ ID NO: 1579 - RNA, 23 nt, Artificial
  Chemically Synthesized
cggggacgaggaauuuuucucca

SEQ ID NO: 1580 - RNA, 23 nt, Artificial
  Chemically Synthesized
ggggacgaggaauuuuucuccau

SEQ ID NO: 1581 - RNA, 23 nt, Artificial
  Chemically Synthesized
gggacgaggaauuuuucuccauu

SEQ ID NO: 1582 - RNA, 23 nt, Artificial
  Chemically Synthesized
ggacgaggaauuuuucuccauua

SEQ ID NO: 1583 - RNA, 23 nt, Artificial
  Chemically Synthesized
ccgccuucuccagcuuggaaugc

SEQ ID NO: 1584 - RNA, 23 nt, Artificial
  Chemically Synthesized
cugagcuuuuauaauacaaaggc

SEQ ID NO: 1585 - RNA, 23 nt, Artificial
  Chemically Synthesized
guuccaggaccaaggagagaggu

SEQ ID NO: 1586 - RNA, 23 nt, Artificial
  Chemically Synthesized
uuccaggaccaaggagagaggua

SEQ ID NO: 1587 - RNA, 23 nt, Artificial
  Chemically Synthesized
cgggguaggucauggcauugauc

SEQ ID NO: 1588 - RNA, 23 nt, Artificial
  Chemically Synthesized
ucagacuuucauuuauucuugcu

SEQ ID NO: 1589 - RNA, 23 nt, Artificial
  Chemically Synthesized
gggggauuccgcuguuaucagca

SEQ ID NO: 1590 - RNA, 23 nt, Artificial
  Chemically Synthesized
accggggacgaggaauuuuucuc

SEQ ID NO: 1591 - RNA, 23 nt, Artificial
  Chemically Synthesized
cuuccccaaaggaagauauuuua

SEQ ID NO: 1592 - RNA, 23 nt, Artificial
  Chemically Synthesized
uuccccaaaggaagauauuuuaa

SEQ ID NO: 1593 - RNA, 23 nt, Artificial
  Chemically Synthesized
uccccaaaggaagauauuuuaag

SEQ ID NO: 1594 - RNA, 23 nt, Artificial
  Chemically Synthesized
ccccaaaggaagauauuuuaaga

SEQ ID NO: 1595 - RNA, 23 nt, Artificial
  Chemically Synthesized
cccaaaggaagauauuuuaagag

SEQ ID NO: 1596 - RNA, 23 nt, Artificial
  Chemically Synthesized
uccgccuucuccagcuuggaaug

SEQ ID NO: 1597 - RNA, 23 nt, Artificial
  Chemically Synthesized
gacgaggaauuuuucuccauuau

SEQ ID NO: 1598 - RNA, 23 nt, Artificial
  Chemically Synthesized
acgaggaauuuuucuccauuaua

SEQ ID NO: 1599 - RNA, 23 nt, Artificial
  Chemically Synthesized
caggaccaaggagagagguagac

SEQ ID NO: 1600 - RNA, 23 nt, Artificial
  Chemically Synthesized
aggaccaaggagagagguagacg

SEQ ID NO: 1601 - RNA, 23 nt, Artificial
  Chemically Synthesized
ggaccaaggagagagguagacgg

SEQ ID NO: 1602 - RNA, 23 nt, Artificial
  Chemically Synthesized
gaccaaggagagagguagacggg

SEQ ID NO: 1603 - RNA, 23 nt, Artificial
  Chemically Synthesized
accaaggagagagguagacgggg

SEQ ID NO: 1604 - RNA, 23 nt, Artificial
  Chemically Synthesized
ggaagauauuuuaagagcauuuu

SEQ ID NO: 1605 - RNA, 23 nt, Artificial
  Chemically Synthesized
cccgggguaggucauggcauuga

SEQ ID NO: 1606 - RNA, 23 nt, Artificial
  Chemically Synthesized
ccgggguaggucauggcauugau

SEQ ID NO: 1607 - RNA, 23 nt, Artificial
  Chemically Synthesized
guccgccuucuccagcuuggaau

SEQ ID NO: 1608 - RNA, 23 nt, Artificial
  Chemically Synthesized
cgaggaauuuuucuccauuauau

SEQ ID NO: 1609 - RNA, 23 nt, Artificial
  Chemically Synthesized
aguucuucacgaaaaagaauuuu

SEQ ID NO: 1610 - RNA, 23 nt, Artificial
  Chemically Synthesized
gcugaggguuuauuauauuuugu

SEQ ID NO: 1611 - RNA, 23 nt, Artificial
  Chemically Synthesized
ggccccguugggaaugaggaaag

SEQ ID NO: 1612 - RNA, 23 nt, Artificial
  Chemically Synthesized
gccccguugggaaugaggaaagc

SEQ ID NO: 1613 - RNA, 23 nt, Artificial
  Chemically Synthesized
gaggaauuuuucuccauuauauc

SEQ ID NO: 1614 - RNA, 23 nt, Artificial
  Chemically Synthesized
cgggggauuccgcuguuaucagc

SEQ ID NO: 1615 - RNA, 23 nt, Artificial
  Chemically Synthesized
ccgagugcgcaccucgguauuaa

SEQ ID NO: 1616 - RNA, 23 nt, Artificial
  Chemically Synthesized
acgggggauuccgcuguuaucag

SEQ ID NO: 1617 - RNA, 23 nt, Artificial
  Chemically Synthesized
gccgagugcgcaccucgguauua

SEQ ID NO: 1618 - RNA, 23 nt, Artificial
  Chemically Synthesized
guucuucacgaaaaagaauuuuu

SEQ ID NO: 1619 - RNA, 23 nt, Artificial
  Chemically Synthesized
aggccccguugggaaugaggaaa

SEQ ID NO: 1620 - RNA, 23 nt, Artificial
  Chemically Synthesized
uccaggaccaaggagagagguag

SEQ ID NO: 1621 - RNA, 23 nt, Artificial
  Chemically Synthesized
ccaggaccaaggagagagguaga

SEQ ID NO: 1622 - RNA, 23 nt, Artificial
  Chemically Synthesized
cgcaauccaauaugaacauauaa

SEQ ID NO: 1623 - RNA, 23 nt, Artificial
  Chemically Synthesized
uuccggaggugcuucacugucau

SEQ ID NO: 1624 - RNA, 23 nt, Artificial
  Chemically Synthesized
uccggaggugcuucacugucauu

SEQ ID NO: 1625 - RNA, 23 nt, Artificial
  Chemically Synthesized
ggcaucacauaaaaaagaaaucu

SEQ ID NO: 1626 - RNA, 23 nt, Artificial
  Chemically Synthesized
gcaauccaauaugaacauauaaa

SEQ ID NO: 1627 - RNA, 19 nt, Artificial
  Chemically Synthesized
ccuccacuaugauccuuaa

SEQ ID NO: 1628 - RNA, 19 nt, Artificial
  Chemically Synthesized
gcuguauccucauaggaaa

SEQ ID NO: 1629 - RNA, 19 nt, Artificial
  Chemically Synthesized
ccgaagccgccauaauaaa

SEQ ID NO: 1630 - RNA, 19 nt, Artificial
  Chemically Synthesized
ccgccauaauaaaaucuga

SEQ ID NO: 1631 - RNA, 19 nt, Artificial
  Chemically Synthesized
cgaagccgccauaauaaaa

SEQ ID NO: 1632 - RNA, 19 nt, Artificial
  Chemically Synthesized
cagagucccugccguuuua

SEQ ID NO: 1633 - RNA, 19 nt, Artificial
  Chemically Synthesized
agaugaagcugcuguacca

SEQ ID NO: 1634 - RNA, 19 nt, Artificial
  Chemically Synthesized
cuaccugaagcacagcaaa

SEQ ID NO: 1635 - RNA, 19 nt, Artificial
  Chemically Synthesized
acgacuuuguacucagaaa

SEQ ID NO: 1636 - RNA, 19 nt, Artificial
  Chemically Synthesized
gguuguucuguguuugcau

SEQ ID NO: 1637 - RNA, 19 nt, Artificial
  Chemically Synthesized
cuccgaagccgccauaaua

SEQ ID NO: 1638 - RNA, 19 nt, Artificial
  Chemically Synthesized
ccaacuccaagcuggagaa

SEQ ID NO: 1639 - RNA, 19 nt, Artificial
  Chemically Synthesized
agaaaaaccgacugcggaa

SEQ ID NO: 1640 - RNA, 19 nt, Artificial
  Chemically Synthesized
cgcagaugaagcugcugua

SEQ ID NO: 1641 - RNA, 19 nt, Artificial
  Chemically Synthesized
cuuuguacucagaaauuga

SEQ ID NO: 1642 - RNA, 19 nt, Artificial
  Chemically Synthesized
guucuguguuugcauuuaa

SEQ ID NO: 1643 - RNA, 19 nt, Artificial
  Chemically Synthesized
cagagaaugugugugcaga

SEQ ID NO: 1644 - RNA, 19 nt, Artificial
  Chemically Synthesized
gcacgacuuuguacucaga

SEQ ID NO: 1645 - RNA, 19 nt, Artificial
  Chemically Synthesized
gguucuaugauauuuguag

SEQ ID NO: 1646 - RNA, 19 nt, Artificial
  Chemically Synthesized
gcuaccugaagcacagcaa

SEQ ID NO: 1647 - RNA, 19 nt, Artificial
  Chemically Synthesized
aacucucagucacguggaa

SEQ ID NO: 1648 - RNA, 19 nt, Artificial
  Chemically Synthesized
cgacuuuguacucagaaau

SEQ ID NO: 1649 - RNA, 19 nt, Artificial
  Chemically Synthesized
ccaaaaggcuccugagugu

SEQ ID NO: 1650 - RNA, 19 nt, Artificial
  Chemically Synthesized
caaucagggcccaucuucu

SEQ ID NO: 1651 - RNA, 19 nt, Artificial
  Chemically Synthesized
cgccauaauaaaaucugau

SEQ ID NO: 1652 - RNA, 19 nt, Artificial
  Chemically Synthesized
ggguucuaugauauuugua

SEQ ID NO: 1653 - RNA, 19 nt, Artificial
  Chemically Synthesized
uggagauggcugucagcua

SEQ ID NO: 1654 - RNA, 19 nt, Artificial
  Chemically Synthesized
cacgacuuuguacucagaa

SEQ ID NO: 1655 - RNA, 19 nt, Artificial
  Chemically Synthesized
ccucauaggaaacagugau

SEQ ID NO: 1656 - RNA, 19 nt, Artificial
  Chemically Synthesized
ggguuguucuguguuugca

SEQ ID NO: 1657 - RNA, 19 nt, Artificial
  Chemically Synthesized
gugugggcacgacuuugua

SEQ ID NO: 1658 - RNA, 19 nt, Artificial
  Chemically Synthesized
gaagccgccauaauaaaau

SEQ ID NO: 1659 - RNA, 19 nt, Artificial
  Chemically Synthesized
cuccacuaugauccuuaaa

SEQ ID NO: 1660 - RNA, 19 nt, Artificial
  Chemically Synthesized
gagaaaaaccgacugcgga

SEQ ID NO: 1661 - RNA, 19 nt, Artificial
  Chemically Synthesized
cucagaaauugaacucuca

SEQ ID NO: 1662 - RNA, 19 nt, Artificial
  Chemically Synthesized
cuaugauccuuaaaggauu

SEQ ID NO: 1663 - RNA, 19 nt, Artificial
  Chemically Synthesized
agcuguauccucauaggaa

SEQ ID NO: 1664 - RNA, 19 nt, Artificial
  Chemically Synthesized
gcaucaacagcagcaucga

SEQ ID NO: 1665 - RNA, 19 nt, Artificial
  Chemically Synthesized
cccugccguuuuaggacaa

SEQ ID NO: 1666 - RNA, 19 nt, Artificial
  Chemically Synthesized
gccuuuugugaaggccgaa

SEQ ID NO: 1667 - RNA, 19 nt, Artificial
  Chemically Synthesized
cuaugauauuuguagugcc

SEQ ID NO: 1668 - RNA, 19 nt, Artificial
  Chemically Synthesized
aggacuacagcgaaggcua

SEQ ID NO: 1669 - RNA, 19 nt, Artificial
  Chemically Synthesized
uccgaagccgccauaauaa

SEQ ID NO: 1670 - RNA, 19 nt, Artificial
  Chemically Synthesized
gccuccacuaugauccuua

SEQ ID NO: 1671 - RNA, 19 nt, Artificial
  Chemically Synthesized
gaacucucagucacgugga

SEQ ID NO: 1672 - RNA, 19 nt, Artificial
  Chemically Synthesized
gcacauuugccuuuuguga

SEQ ID NO: 1673 - RNA, 19 nt, Artificial
  Chemically Synthesized
agcaagugacuucugggaa

SEQ ID NO: 1674 - RNA, 19 nt, Artificial
  Chemically Synthesized
cugucagcuaccugaagca

SEQ ID NO: 1675 - RNA, 19 nt, Artificial
  Chemically Synthesized
uggcugucagcuaccugaa

SEQ ID NO: 1676 - RNA, 19 nt, Artificial
  Chemically Synthesized
cacauuugccuuuugugaa

SEQ ID NO: 1677 - RNA, 19 nt, Artificial
  Chemically Synthesized
gccguuuuaggacaaucag

SEQ ID NO: 1678 - RNA, 19 nt, Artificial
  Chemically Synthesized
cucagagaaugugugugca

SEQ ID NO: 1679 - RNA, 19 nt, Artificial
  Chemically Synthesized
gacuuuguacucagaaauu

SEQ ID NO: 1680 - RNA, 19 nt, Artificial
  Chemically Synthesized
cacuaugauccuuaaagga

SEQ ID NO: 1681 - RNA, 19 nt, Artificial
  Chemically Synthesized
uugugaaggccgaacucga

SEQ ID NO: 1682 - RNA, 19 nt, Artificial
  Chemically Synthesized
agcugcuguaccacuucca

SEQ ID NO: 1683 - RNA, 19 nt, Artificial
  Chemically Synthesized
gcaagugacuucugggaag

SEQ ID NO: 1684 - RNA, 19 nt, Artificial
  Chemically Synthesized
uguucuguguuugcauuua

SEQ ID NO: 1685 - RNA, 19 nt, Artificial
  Chemically Synthesized
ccaaagagaaaaaccgacu

SEQ ID NO: 1686 - RNA, 19 nt, Artificial
  Chemically Synthesized
ccguuuuaggacaaucagg

SEQ ID NO: 1687 - RNA, 19 nt, Artificial
  Chemically Synthesized
agagaaugugugugcagag

SEQ ID NO: 1688 - RNA, 19 nt, Artificial
  Chemically Synthesized
ucagcuaccugaagcacag

SEQ ID NO: 1689 - RNA, 19 nt, Artificial
  Chemically Synthesized
cucgagcuguauccucaua

SEQ ID NO: 1690 - RNA, 19 nt, Artificial
  Chemically Synthesized
guuguucuguguuugcauu

SEQ ID NO: 1691 - RNA, 19 nt, Artificial
  Chemically Synthesized
gagaaugugugugcagagu

SEQ ID NO: 1692 - RNA, 19 nt, Artificial
  Chemically Synthesized
ugccuuuugugaaggccga

SEQ ID NO: 1693 - RNA, 19 nt, Artificial
  Chemically Synthesized
gaaugugugugcagagucc

SEQ ID NO: 1694 - RNA, 19 nt, Artificial
  Chemically Synthesized
auggcugucagcuaccuga

SEQ ID NO: 1695 - RNA, 19 nt, Artificial
  Chemically Synthesized
cauaggaaacagugaucac

SEQ ID NO: 1696 - RNA, 19 nt, Artificial
  Chemically Synthesized
gggcacgacuuuguacuca

SEQ ID NO: 1697 - RNA, 19 nt, Artificial
  Chemically Synthesized
cgagcuguauccucauagg

SEQ ID NO: 1698 - RNA, 19 nt, Artificial
  Chemically Synthesized
acucgagcuguauccucau

SEQ ID NO: 1699 - RNA, 19 nt, Artificial
  Chemically Synthesized
cuguguuugcauuuaagca

SEQ ID NO: 1700 - RNA, 19 nt, Artificial
  Chemically Synthesized
gaaauugaacucucaguca

SEQ ID NO: 1701 - RNA, 19 nt, Artificial
  Chemically Synthesized
gagcuguauccucauagga

SEQ ID NO: 1702 - RNA, 19 nt, Artificial
  Chemically Synthesized
cgggcacauuugccuuuug

SEQ ID NO: 1703 - RNA, 19 nt, Artificial
  Chemically Synthesized
cccaaagagaaaaaccgac

SEQ ID NO: 1704 - RNA, 19 nt, Artificial
  Chemically Synthesized
uccucauaggaaacaguga

SEQ ID NO: 1705 - RNA, 19 nt, Artificial
  Chemically Synthesized
aagcaagugacuucuggga

SEQ ID NO: 1706 - RNA, 19 nt, Artificial
  Chemically Synthesized
uguguuugcauuuaagcaa

SEQ ID NO: 1707 - RNA, 19 nt, Artificial
  Chemically Synthesized
caucuucugccaagugucu

SEQ ID NO: 1708 - RNA, 19 nt, Artificial
  Chemically Synthesized
ggcacgacuuuguacucag

SEQ ID NO: 1709 - RNA, 19 nt, Artificial
  Chemically Synthesized
gggcacauuugccuuuugu

SEQ ID NO: 1710 - RNA, 19 nt, Artificial
  Chemically Synthesized
uucuguguuugcauuuaag

SEQ ID NO: 1711 - RNA, 19 nt, Artificial
  Chemically Synthesized
ucuucugccaagugucuga

SEQ ID NO: 1712 - RNA, 19 nt, Artificial
  Chemically Synthesized
acauuugccuuuugugaag

SEQ ID NO: 1713 - RNA, 19 nt, Artificial
  Chemically Synthesized
ucaacagcagcaucgagca

SEQ ID NO: 1714 - RNA, 19 nt, Artificial
  Chemically Synthesized
cguuuuaggacaaucaggg

SEQ ID NO: 1715 - RNA, 19 nt, Artificial
  Chemically Synthesized
ccacuaugauccuuaaagg

SEQ ID NO: 1716 - RNA, 19 nt, Artificial
  Chemically Synthesized
ugccguuuuaggacaauca

SEQ ID NO: 1717 - RNA, 19 nt, Artificial
  Chemically Synthesized
gucagcuaccugaagcaca

SEQ ID NO: 1718 - RNA, 19 nt, Artificial
  Chemically Synthesized
aacucgagcuguauccuca

SEQ ID NO: 1719 - RNA, 19 nt, Artificial
  Chemically Synthesized
gcgggcacauuugccuuuu

SEQ ID NO: 1720 - RNA, 19 nt, Artificial
  Chemically Synthesized
accuguagaggacuuucuu

SEQ ID NO: 1721 - RNA, 19 nt, Artificial
  Chemically Synthesized
ccugccguuuuaggacaau

SEQ ID NO: 1722 - RNA, 19 nt, Artificial
  Chemically Synthesized
agucccugccguuuuagga

SEQ ID NO: 1723 - RNA, 19 nt, Artificial
  Chemically Synthesized
cuguagaggacuuucuuca

SEQ ID NO: 1724 - RNA, 19 nt, Artificial
  Chemically Synthesized
cagaaauugaacucucagu

SEQ ID NO: 1725 - RNA, 19 nt, Artificial
  Chemically Synthesized
ccuuaaaggauuccucugu

SEQ ID NO: 1726 - RNA, 19 nt, Artificial
  Chemically Synthesized
caaagagaaaaaccgacug

SEQ ID NO: 1727 - RNA, 19 nt, Artificial
  Chemically Synthesized
cuuuugugaaggccgaacu

SEQ ID NO: 1728 - RNA, 19 nt, Artificial
  Chemically Synthesized
ccauucucagagaaugugu

SEQ ID NO: 1729 - RNA, 19 nt, Artificial
  Chemically Synthesized
ugaagcugcuguaccacuu

SEQ ID NO: 1730 - RNA, 19 nt, Artificial
  Chemically Synthesized
ugauauuuguagugccggg

SEQ ID NO: 1731 - RNA, 19 nt, Artificial
  Chemically Synthesized
uguuugcauuuaagcaagu

SEQ ID NO: 1732 - RNA, 19 nt, Artificial
  Chemically Synthesized
augugugugcagagucccu

SEQ ID NO: 1733 - RNA, 19 nt, Artificial
  Chemically Synthesized
acacgcagaugaagcugcu

SEQ ID NO: 1734 - RNA, 19 nt, Artificial
  Chemically Synthesized
ccaaccuguagaggacuuu

SEQ ID NO: 1735 - RNA, 19 nt, Artificial
  Chemically Synthesized
cccaaccuguagaggacuu

SEQ ID NO: 1736 - RNA, 19 nt, Artificial
  Chemically Synthesized
gacaaucagggcccaucuu

SEQ ID NO: 1737 - RNA, 19 nt, Artificial
  Chemically Synthesized
ucauaggaaacagugauca

SEQ ID NO: 1738 - RNA, 19 nt, Artificial
  Chemically Synthesized
uaugauauuuguagugccg

SEQ ID NO: 1739 - RNA, 19 nt, Artificial
  Chemically Synthesized
ugaagcacagcaaagccuu

SEQ ID NO: 1740 - RNA, 19 nt, Artificial
  Chemically Synthesized
ugggugccuccacuaugau

SEQ ID NO: 1741 - RNA, 19 nt, Artificial
  Chemically Synthesized
guguuugcauuuaagcaag

SEQ ID NO: 1742 - RNA, 19 nt, Artificial
  Chemically Synthesized
ccaucuucugccaaguguc

SEQ ID NO: 1743 - RNA, 19 nt, Artificial
  Chemically Synthesized
ucagaaauugaacucucag

SEQ ID NO: 1744 - RNA, 19 nt, Artificial
  Chemically Synthesized
auggccaaaaggcuccuga

SEQ ID NO: 1745 - RNA, 19 nt, Artificial
  Chemically Synthesized
uauccucauaggaaacagu

SEQ ID NO: 1746 - RNA, 19 nt, Artificial
  Chemically Synthesized
acuuucuucagggcccgua

SEQ ID NO: 1747 - RNA, 19 nt, Artificial
  Chemically Synthesized
ggcacauuugccuuuugug

SEQ ID NO: 1748 - RNA, 19 nt, Artificial
  Chemically Synthesized
caucaacagcagcaucgag

SEQ ID NO: 1749 - RNA, 19 nt, Artificial
  Chemically Synthesized
gcauuuaagcaagugacuu

SEQ ID NO: 1750 - RNA, 19 nt, Artificial
  Chemically Synthesized
uacagcgaaggcuacucgu

SEQ ID NO: 1751 - RNA, 19 nt, Artificial
  Chemically Synthesized
gacuacagcgaaggcuacu

SEQ ID NO: 1752 - RNA, 19 nt, Artificial
  Chemically Synthesized
cccaucuucugccaagugu

SEQ ID NO: 1753 - RNA, 19 nt, Artificial
  Chemically Synthesized
aagccgccauaauaaaauc

SEQ ID NO: 1754 - RNA, 19 nt, Artificial
  Chemically Synthesized
aggauuccucugugugggu

SEQ ID NO: 1755 - RNA, 19 nt, Artificial
  Chemically Synthesized
cuuaaaggauuccucugug

SEQ ID NO: 1756 - RNA, 19 nt, Artificial
  Chemically Synthesized
ucagagaaugugugugcag

SEQ ID NO: 1757 - RNA, 19 nt, Artificial
  Chemically Synthesized
uuaggacaaucagggccca

SEQ ID NO: 1758 - RNA, 19 nt, Artificial
  Chemically Synthesized
gaagcacagcaaagccuuc

SEQ ID NO: 1759 - RNA, 19 nt, Artificial
  Chemically Synthesized
uguacucagaaauugaacu

SEQ ID NO: 1760 - RNA, 19 nt, Artificial
  Chemically Synthesized
cgaacucgagcuguauccu

SEQ ID NO: 1761 - RNA, 19 nt, Artificial
  Chemically Synthesized
agaggacuuucuucagggc

SEQ ID NO: 1762 - RNA, 19 nt, Artificial
  Chemically Synthesized
gugccuccacuaugauccu

SEQ ID NO: 1763 - RNA, 19 nt, Artificial
  Chemically Synthesized
uguagaggacuuucuucag

SEQ ID NO: 1764 - RNA, 19 nt, Artificial
  Chemically Synthesized
ugcauuuaagcaagugacu

SEQ ID NO: 1765 - RNA, 19 nt, Artificial
  Chemically Synthesized
gaaaaaccgacugcggaag

SEQ ID NO: 1766 - RNA, 19 nt, Artificial
  Chemically Synthesized
caaccuguagaggacuuuc

SEQ ID NO: 1767 - RNA, 19 nt, Artificial
  Chemically Synthesized
caagugacuucugggaagu

SEQ ID NO: 1768 - RNA, 19 nt, Artificial
  Chemically Synthesized
guuuuaggacaaucagggc

SEQ ID NO: 1769 - RNA, 19 nt, Artificial
  Chemically Synthesized
gccgccauaauaaaaucug

SEQ ID NO: 1770 - RNA, 19 nt, Artificial
  Chemically Synthesized
aauugaacucucagucacg

SEQ ID NO: 1771 - RNA, 19 nt, Artificial
  Chemically Synthesized
accgcaucaacagcagcau

SEQ ID NO: 1772 - RNA, 19 nt, Artificial
  Chemically Synthesized
uaggacaaucagggcccau

SEQ ID NO: 1773 - RNA, 19 nt, Artificial
  Chemically Synthesized
uaccugaagcacagcaaag

SEQ ID NO: 1774 - RNA, 19 nt, Artificial
  Chemically Synthesized
uuaaaggauuccucugugu

SEQ ID NO: 1775 - RNA, 19 nt, Artificial
  Chemically Synthesized
acauccuggagauggcugu

SEQ ID NO: 1776 - RNA, 19 nt, Artificial
  Chemically Synthesized
ucccugccguuuuaggaca

SEQ ID NO: 1777 - RNA, 19 nt, Artificial
  Chemically Synthesized
cauucucagagaaugugug

SEQ ID NO: 1778 - RNA, 19 nt, Artificial
  Chemically Synthesized
agauggcugucagcuaccu

SEQ ID NO: 1779 - RNA, 19 nt, Artificial
  Chemically Synthesized
caaaaggcuccugagugug

SEQ ID NO: 1780 - RNA, 19 nt, Artificial
  Chemically Synthesized
guagaggacuuucuucagg

SEQ ID NO: 1781 - RNA, 19 nt, Artificial
  Chemically Synthesized
ccuguagaggacuuucuuc

SEQ ID NO: 1782 - RNA, 19 nt, Artificial
  Chemically Synthesized
uuugcauuuaagcaaguga

SEQ ID NO: 1783 - RNA, 19 nt, Artificial
  Chemically Synthesized
agagaaaaaccgacugcgg

SEQ ID NO: 1784 - RNA, 19 nt, Artificial
  Chemically Synthesized
gcagaugaagcugcuguac

SEQ ID NO: 1785 - RNA, 19 nt, Artificial
  Chemically Synthesized
agcacagcaaagccuucgu

SEQ ID NO: 1786 - RNA, 19 nt, Artificial
  Chemically Synthesized
acuuuguacucagaaauug

SEQ ID NO: 1787 - RNA, 19 nt, Artificial
  Chemically Synthesized
gugggcacgacuuuguacu

SEQ ID NO: 1788 - RNA, 19 nt, Artificial
  Chemically Synthesized
gauccuuaaaggauuccuc

SEQ ID NO: 1789 - RNA, 19 nt, Artificial
  Chemically Synthesized
uccacuaugauccuuaaag

SEQ ID NO: 1790 - RNA, 19 nt, Artificial
  Chemically Synthesized
cucauaggaaacagugauc

SEQ ID NO: 1791 - RNA, 19 nt, Artificial
  Chemically Synthesized
cuguauccucauaggaaac

SEQ ID NO: 1792 - RNA, 19 nt, Artificial
  Chemically Synthesized
cagaugaagcugcuguacc

SEQ ID NO: 1793 - RNA, 19 nt, Artificial
  Chemically Synthesized
acuaugauccuuaaaggau

SEQ ID NO: 1794 - RNA, 19 nt, Artificial
  Chemically Synthesized
guauccucauaggaaacag

SEQ ID NO: 1795 - RNA, 19 nt, Artificial
  Chemically Synthesized
aaccuguagaggacuuucu

SEQ ID NO: 1796 - RNA, 19 nt, Artificial
  Chemically Synthesized
agagucccugccguuuuag

SEQ ID NO: 1797 - RNA, 19 nt, Artificial
  Chemically Synthesized
gaagcugcuguaccacuuc

SEQ ID NO: 1798 - RNA, 19 nt, Artificial
  Chemically Synthesized
acgcagaugaagcugcugu

SEQ ID NO: 1799 - RNA, 19 nt, Artificial
  Chemically Synthesized
agccgccauaauaaaaucu

SEQ ID NO: 1800 - RNA, 19 nt, Artificial
  Chemically Synthesized
caacuccaagcuggagaag

SEQ ID NO: 1801 - RNA, 19 nt, Artificial
  Chemically Synthesized
agcuaccugaagcacagca

SEQ ID NO: 1802 - RNA, 19 nt, Artificial
  Chemically Synthesized
auuccucugugugggugga

SEQ ID NO: 1803 - RNA, 19 nt, Artificial
  Chemically Synthesized
uuuugugaaggccgaacuc

SEQ ID NO: 1804 - RNA, 19 nt, Artificial
  Chemically Synthesized
cugaagcacagcaaagccu

SEQ ID NO: 1805 - RNA, 19 nt, Artificial
  Chemically Synthesized
auugaacucucagucacgu

SEQ ID NO: 1806 - RNA, 19 nt, Artificial
  Chemically Synthesized
uuguucuguguuugcauuu

SEQ ID NO: 1807 - RNA, 19 nt, Artificial
  Chemically Synthesized
agaaugugugugcagaguc

SEQ ID NO: 1808 - RNA, 19 nt, Artificial
  Chemically Synthesized
gaugaagcugcuguaccac

SEQ ID NO: 1809 - RNA, 19 nt, Artificial
  Chemically Synthesized
ugugggcacgacuuuguac

SEQ ID NO: 1810 - RNA, 19 nt, Artificial
  Chemically Synthesized
cauuuaagcaagugacuuc

SEQ ID NO: 1811 - RNA, 19 nt, Artificial
  Chemically Synthesized
aaaucugauuguucagccc

SEQ ID NO: 1812 - RNA, 19 nt, Artificial
  Chemically Synthesized
aaauugaacucucagucac

SEQ ID NO: 1813 - RNA, 19 nt, Artificial
  Chemically Synthesized
ccuuuugugaaggccgaac

SEQ ID NO: 1814 - RNA, 19 nt, Artificial
  Chemically Synthesized
acaaucagggcccaucuuc

SEQ ID NO: 1815 - RNA, 19 nt, Artificial
  Chemically Synthesized
cccauucucagagaaugug

SEQ ID NO: 1816 - RNA, 19 nt, Artificial
  Chemically Synthesized
aagagaaaaaccgacugcg

SEQ ID NO: 1817 - RNA, 19 nt, Artificial
  Chemically Synthesized
aaaggauuccucugugugg

SEQ ID NO: 1818 - RNA, 19 nt, Artificial
  Chemically Synthesized
auccuuaaaggauuccucu

SEQ ID NO: 1819 - RNA, 19 nt, Artificial
  Chemically Synthesized
ugccuccacuaugauccuu

SEQ ID NO: 1820 - RNA, 19 nt, Artificial
  Chemically Synthesized
augauauuuguagugccgg

SEQ ID NO: 1821 - RNA, 19 nt, Artificial
  Chemically Synthesized
auuuaagcaagugacuucu

SEQ ID NO: 1822 - RNA, 19 nt, Artificial
  Chemically Synthesized
uuaagcaagugacuucugg

SEQ ID NO: 1823 - RNA, 19 nt, Artificial
  Chemically Synthesized
guuugcauuuaagcaagug

SEQ ID NO: 1824 - RNA, 19 nt, Artificial
  Chemically Synthesized
cugccguuuuaggacaauc

SEQ ID NO: 1825 - RNA, 19 nt, Artificial
  Chemically Synthesized
accugaagcacagcaaagc

SEQ ID NO: 1826 - RNA, 19 nt, Artificial
  Chemically Synthesized
aaaaggcuccugagugugc

SEQ ID NO: 1827 - RNA, 19 nt, Artificial
  Chemically Synthesized
uaagcaagugacuucuggg

SEQ ID NO: 1828 - RNA, 19 nt, Artificial
  Chemically Synthesized
aaucagggcccaucuucug

SEQ ID NO: 1829 - RNA, 19 nt, Artificial
  Chemically Synthesized
acucagaaauugaacucuc

SEQ ID NO: 1830 - RNA, 19 nt, Artificial
  Chemically Synthesized
gaacucgagcuguauccuc

SEQ ID NO: 1831 - RNA, 19 nt, Artificial
  Chemically Synthesized
augaagcugcuguaccacu

SEQ ID NO: 1832 - RNA, 19 nt, Artificial
  Chemically Synthesized
uuguacucagaaauugaac

SEQ ID NO: 1833 - RNA, 19 nt, Artificial
  Chemically Synthesized
ugggcacgacuuuguacuc

SEQ ID NO: 1834 - RNA, 19 nt, Artificial
  Chemically Synthesized
ucuaugauauuuguagugc

SEQ ID NO: 1835 - RNA, 19 nt, Artificial
  Chemically Synthesized
uugcauuuaagcaagugac

SEQ ID NO: 1836 - RNA, 19 nt, Artificial
  Chemically Synthesized
aaagagaaaaaccgacugc

SEQ ID NO: 1837 - RNA, 19 nt, Artificial
  Chemically Synthesized
ucgagcuguauccucauag

SEQ ID NO: 1838 - RNA, 19 nt, Artificial
  Chemically Synthesized
uagaggacuuucuucaggg

SEQ ID NO: 1839 - RNA, 19 nt, Artificial
  Chemically Synthesized
ugucagcuaccugaagcac

SEQ ID NO: 1840 - RNA, 19 nt, Artificial
  Chemically Synthesized
agaaauugaacucucaguc

SEQ ID NO: 1841 - RNA, 19 nt, Artificial
  Chemically Synthesized
ugauccuuaaaggauuccu

SEQ ID NO: 1842 - RNA, 19 nt, Artificial
  Chemically Synthesized
auccuggagauggcuguca

SEQ ID NO: 1843 - RNA, 19 nt, Artificial
  Chemically Synthesized
auucucagagaaugugugu

SEQ ID NO: 1844 - RNA, 19 nt, Artificial
  Chemically Synthesized
uccuuaaaggauuccucug

SEQ ID NO: 1845 - RNA, 19 nt, Artificial
  Chemically Synthesized
uaugauccuuaaaggauuc

SEQ ID NO: 1846 - RNA, 19 nt, Artificial
  Chemically Synthesized
uguauccucauaggaaaca

SEQ ID NO: 1847 - RNA, 19 nt, Artificial
  Chemically Synthesized
ucucagagaaugugugugc

SEQ ID NO: 1848 - RNA, 19 nt, Artificial
  Chemically Synthesized
ugaacucucagucacgugg

SEQ ID NO: 1849 - RNA, 19 nt, Artificial
  Chemically Synthesized
guacucagaaauugaacuc

SEQ ID NO: 1850 - RNA, 19 nt, Artificial
  Chemically Synthesized
aaaaucugauuguucagcc

SEQ ID NO: 1851 - RNA, 19 nt, Artificial
  Chemically Synthesized
aaugugugugcagaguccc

SEQ ID NO: 1852 - RNA, 19 nt, Artificial
  Chemically Synthesized
acuacagcgaaggcuacuc

SEQ ID NO: 1853 - RNA, 19 nt, Artificial
  Chemically Synthesized
aaggauuccucuguguggg

SEQ ID NO: 1854 - RNA, 19 nt, Artificial
  Chemically Synthesized
uaaaggauuccucugugug

SEQ ID NO: 1855 - RNA, 19 nt, Artificial
  Chemically Synthesized
uaggaaacagugaucaccc

SEQ ID NO: 1856 - RNA, 19 nt, Artificial
  Chemically Synthesized
uugccuuuugugaaggccg

SEQ ID NO: 1857 - RNA, 19 nt, Artificial
  Chemically Synthesized
ucuguguuugcauuuaagc

SEQ ID NO: 1858 - RNA, 19 nt, Artificial
  Chemically Synthesized
aaaaaccgacugcggaagc

SEQ ID NO: 1859 - RNA, 19 nt, Artificial
  Chemically Synthesized
aacuccaagcuggagaagg

SEQ ID NO: 1860 - RNA, 19 nt, Artificial
  Chemically Synthesized
cauuugccuuuugugaagg

SEQ ID NO: 1861 - RNA, 19 nt, Artificial
  Chemically Synthesized
acucucagucacguggaag

SEQ ID NO: 1862 - RNA, 19 nt, Artificial
  Chemically Synthesized
uacucagaaauugaacucu

SEQ ID NO: 1863 - RNA, 19 nt, Artificial
  Chemically Synthesized
uuuaagcaagugacuucug

SEQ ID NO: 1864 - RNA, 19 nt, Artificial
  Chemically Synthesized
agugacuucugggaagucc

SEQ ID NO: 1865 - RNA, 19 nt, Artificial
  Chemically Synthesized
aagugacuucugggaaguc

SEQ ID NO: 1866 - RNA, 19 nt, Artificial
  Chemically Synthesized
aagcugcuguaccacuucc

SEQ ID NO: 1867 - RNA, 19 nt, Artificial
  Chemically Synthesized
uuccucuguguggguggau

SEQ ID NO: 1868 - RNA, 19 nt, Artificial
  Chemically Synthesized
auccucauaggaaacagug

SEQ ID NO: 1869 - RNA, 19 nt, Artificial
  Chemically Synthesized
uucucagagaaugugugug

SEQ ID NO: 1870 - RNA, 19 nt, Artificial
  Chemically Synthesized
auaggaaacagugaucacc

SEQ ID NO: 1871 - RNA, 19 nt, Artificial
  Chemically Synthesized
uugaacucucagucacgug

SEQ ID NO: 1872 - RNA, 19 nt, Artificial
  Chemically Synthesized
auuugccuuuugugaaggc

SEQ ID NO: 1873 - RNA, 19 nt, Artificial
  Chemically Synthesized
cuucugccaagugucugac

SEQ ID NO: 1874 - RNA, 19 nt, Artificial
  Chemically Synthesized
aucaacagcagcaucgagc

SEQ ID NO: 1875 - RNA, 19 nt, Artificial
  Chemically Synthesized
aucuucugccaagugucug

SEQ ID NO: 1876 - RNA, 19 nt, Artificial
  Chemically Synthesized
uuuuaggacaaucagggcc

SEQ ID NO: 1877 - RNA, 19 nt, Artificial
  Chemically Synthesized
aagcacagcaaagccuucg

SEQ ID NO: 1878 - RNA, 19 nt, Artificial
  Chemically Synthesized
uucugccaagugucugacc

SEQ ID NO: 1879 - RNA, 19 nt, Artificial
  Chemically Synthesized
uuugugaaggccgaacucg

SEQ ID NO: 1880 - RNA, 19 nt, Artificial
  Chemically Synthesized
uuuaggacaaucagggccc

SEQ ID NO: 1881 - RNA, 19 nt, Artificial
  Chemically Synthesized
uaaaaucugauuguucagc

SEQ ID NO: 1882 - RNA, 19 nt, Artificial
  Chemically Synthesized
uuugccuuuugugaaggcc

SEQ ID NO: 1883 - RNA, 19 nt, Artificial
  Chemically Synthesized
augauccuuaaaggauucc

SEQ ID NO: 1884 - RNA, 19 nt, Artificial
  Chemically Synthesized
uuaaggaucauaguggagg

SEQ ID NO: 1885 - RNA, 19 nt, Artificial
  Chemically Synthesized
uuuccuaugaggauacagc

SEQ ID NO: 1886 - RNA, 19 nt, Artificial
  Chemically Synthesized
uuuauuauggcggcuucgg

SEQ ID NO: 1887 - RNA, 19 nt, Artificial
  Chemically Synthesized
ucagauuuuauuauggcgg

SEQ ID NO: 1888 - RNA, 19 nt, Artificial
  Chemically Synthesized
uuuuauuauggcggcuucg

SEQ ID NO: 1889 - RNA, 19 nt, Artificial
  Chemically Synthesized
uaaaacggcagggacucug

SEQ ID NO: 1890 - RNA, 19 nt, Artificial
  Chemically Synthesized
ugguacagcagcuucaucu

SEQ ID NO: 1891 - RNA, 19 nt, Artificial
  Chemically Synthesized
uuugcugugcuucagguag

SEQ ID NO: 1892 - RNA, 19 nt, Artificial
  Chemically Synthesized
uuucugaguacaaagucgu

SEQ ID NO: 1893 - RNA, 19 nt, Artificial
  Chemically Synthesized
augcaaacacagaacaacc

SEQ ID NO: 1894 - RNA, 19 nt, Artificial
  Chemically Synthesized
uauuauggcggcuucggag

SEQ ID NO: 1895 - RNA, 19 nt, Artificial
  Chemically Synthesized
uucuccagcuuggaguugg

SEQ ID NO: 1896 - RNA, 19 nt, Artificial
  Chemically Synthesized
uuccgcagucgguuuuucu

SEQ ID NO: 1897 - RNA, 19 nt, Artificial
  Chemically Synthesized
uacagcagcuucaucugcg

SEQ ID NO: 1898 - RNA, 19 nt, Artificial
  Chemically Synthesized
ucaauuucugaguacaaag

SEQ ID NO: 1899 - RNA, 19 nt, Artificial
  Chemically Synthesized
uuaaaugcaaacacagaac

SEQ ID NO: 1900 - RNA, 19 nt, Artificial
  Chemically Synthesized
ucugcacacacauucucug

SEQ ID NO: 1901 - RNA, 19 nt, Artificial
  Chemically Synthesized
ucugaguacaaagucgugc

SEQ ID NO: 1902 - RNA, 19 nt, Artificial
  Chemically Synthesized
cuacaaauaucauagaacc

SEQ ID NO: 1903 - RNA, 19 nt, Artificial
  Chemically Synthesized
uugcugugcuucagguagc

SEQ ID NO: 1904 - RNA, 19 nt, Artificial
  Chemically Synthesized
uuccacgugacugagaguu

SEQ ID NO: 1905 - RNA, 19 nt, Artificial
  Chemically Synthesized
auuucugaguacaaagucg

SEQ ID NO: 1906 - RNA, 19 nt, Artificial
  Chemically Synthesized
acacucaggagccuuuugg

SEQ ID NO: 1907 - RNA, 19 nt, Artificial
  Chemically Synthesized
agaagaugggcccugauug

SEQ ID NO: 1908 - RNA, 19 nt, Artificial
  Chemically Synthesized
aucagauuuuauuauggcg

SEQ ID NO: 1909 - RNA, 19 nt, Artificial
  Chemically Synthesized
uacaaauaucauagaaccc

SEQ ID NO: 1910 - RNA, 19 nt, Artificial
  Chemically Synthesized
uagcugacagccaucucca

SEQ ID NO: 1911 - RNA, 19 nt, Artificial
  Chemically Synthesized
uucugaguacaaagucgug

SEQ ID NO: 1912 - RNA, 19 nt, Artificial
  Chemically Synthesized
aucacuguuuccuaugagg

SEQ ID NO: 1913 - RNA, 19 nt, Artificial
  Chemically Synthesized
ugcaaacacagaacaaccc

SEQ ID NO: 1914 - RNA, 19 nt, Artificial
  Chemically Synthesized
uacaaagucgugcccacac

SEQ ID NO: 1915 - RNA, 19 nt, Artificial
  Chemically Synthesized
auuuuauuauggcggcuuc

SEQ ID NO: 1916 - RNA, 19 nt, Artificial
  Chemically Synthesized
uuuaaggaucauaguggag

SEQ ID NO: 1917 - RNA, 19 nt, Artificial
  Chemically Synthesized
uccgcagucgguuuuucuc

SEQ ID NO: 1918 - RNA, 19 nt, Artificial
  Chemically Synthesized
ugagaguucaauuucugag

SEQ ID NO: 1919 - RNA, 19 nt, Artificial
  Chemically Synthesized
aauccuuuaaggaucauag

SEQ ID NO: 1920 - RNA, 19 nt, Artificial
  Chemically Synthesized
uuccuaugaggauacagcu

SEQ ID NO: 1921 - RNA, 19 nt, Artificial
  Chemically Synthesized
ucgaugcugcuguugaugc

SEQ ID NO: 1922 - RNA, 19 nt, Artificial
  Chemically Synthesized
uuguccuaaaacggcaggg

SEQ ID NO: 1923 - RNA, 19 nt, Artificial
  Chemically Synthesized
uucggccuucacaaaaggc

SEQ ID NO: 1924 - RNA, 19 nt, Artificial
  Chemically Synthesized
ggcacuacaaauaucauag

SEQ ID NO: 1925 - RNA, 19 nt, Artificial
  Chemically Synthesized
uagccuucgcuguaguccu

SEQ ID NO: 1926 - RNA, 19 nt, Artificial
  Chemically Synthesized
uuauuauggcggcuucgga

SEQ ID NO: 1927 - RNA, 19 nt, Artificial
  Chemically Synthesized
uaaggaucauaguggaggc

SEQ ID NO: 1928 - RNA, 19 nt, Artificial
  Chemically Synthesized
uccacgugacugagaguuc

SEQ ID NO: 1929 - RNA, 19 nt, Artificial
  Chemically Synthesized
ucacaaaaggcaaaugugc

SEQ ID NO: 1930 - RNA, 19 nt, Artificial
  Chemically Synthesized
uucccagaagucacuugcu

SEQ ID NO: 1931 - RNA, 19 nt, Artificial
  Chemically Synthesized
ugcuucagguagcugacag

SEQ ID NO: 1932 - RNA, 19 nt, Artificial
  Chemically Synthesized
uucagguagcugacagcca

SEQ ID NO: 1933 - RNA, 19 nt, Artificial
  Chemically Synthesized
uucacaaaaggcaaaugug

SEQ ID NO: 1934 - RNA, 19 nt, Artificial
  Chemically Synthesized
cugauuguccuaaaacggc

SEQ ID NO: 1935 - RNA, 19 nt, Artificial
  Chemically Synthesized
ugcacacacauucucugag

SEQ ID NO: 1936 - RNA, 19 nt, Artificial
  Chemically Synthesized
aauuucugaguacaaaguc

SEQ ID NO: 1937 - RNA, 19 nt, Artificial
  Chemically Synthesized
uccuuuaaggaucauagug

SEQ ID NO: 1938 - RNA, 19 nt, Artificial
  Chemically Synthesized
ucgaguucggccuucacaa

SEQ ID NO: 1939 - RNA, 19 nt, Artificial
  Chemically Synthesized
uggaagugguacagcagcu

SEQ ID NO: 1940 - RNA, 19 nt, Artificial
  Chemically Synthesized
cuucccagaagucacuugc

SEQ ID NO: 1941 - RNA, 19 nt, Artificial
  Chemically Synthesized
uaaaugcaaacacagaaca

SEQ ID NO: 1942 - RNA, 19 nt, Artificial
  Chemically Synthesized
agucgguuuuucucuuugg

SEQ ID NO: 1943 - RNA, 19 nt, Artificial
  Chemically Synthesized
ccugauuguccuaaaacgg

SEQ ID NO: 1944 - RNA, 19 nt, Artificial
  Chemically Synthesized
cucugcacacacauucucu

SEQ ID NO: 1945 - RNA, 19 nt, Artificial
  Chemically Synthesized
cugugcuucagguagcuga

SEQ ID NO: 1946 - RNA, 19 nt, Artificial
  Chemically Synthesized
uaugaggauacagcucgag

SEQ ID NO: 1947 - RNA, 19 nt, Artificial
  Chemically Synthesized
aaugcaaacacagaacaac

SEQ ID NO: 1948 - RNA, 19 nt, Artificial
  Chemically Synthesized
acucugcacacacauucuc

SEQ ID NO: 1949 - RNA, 19 nt, Artificial
  Chemically Synthesized
ucggccuucacaaaaggca

SEQ ID NO: 1950 - RNA, 19 nt, Artificial
  Chemically Synthesized
ggacucugcacacacauuc

SEQ ID NO: 1951 - RNA, 19 nt, Artificial
  Chemically Synthesized
ucagguagcugacagccau

SEQ ID NO: 1952 - RNA, 19 nt, Artificial
  Chemically Synthesized
gugaucacuguuuccuaug

SEQ ID NO: 1953 - RNA, 19 nt, Artificial
  Chemically Synthesized
ugaguacaaagucgugccc

SEQ ID NO: 1954 - RNA, 19 nt, Artificial
  Chemically Synthesized
ccuaugaggauacagcucg

SEQ ID NO: 1955 - RNA, 19 nt, Artificial
  Chemically Synthesized
augaggauacagcucgagu

SEQ ID NO: 1956 - RNA, 19 nt, Artificial
  Chemically Synthesized
ugcuuaaaugcaaacacag

SEQ ID NO: 1957 - RNA, 19 nt, Artificial
  Chemically Synthesized
ugacugagaguucaauuuc

SEQ ID NO: 1958 - RNA, 19 nt, Artificial
  Chemically Synthesized
uccuaugaggauacagcuc

SEQ ID NO: 1959 - RNA, 19 nt, Artificial
  Chemically Synthesized
caaaaggcaaaugugcccg

SEQ ID NO: 1960 - RNA, 19 nt, Artificial
  Chemically Synthesized
gucgguuuuucucuuuggg

SEQ ID NO: 1961 - RNA, 19 nt, Artificial
  Chemically Synthesized
ucacuguuuccuaugagga

SEQ ID NO: 1962 - RNA, 19 nt, Artificial
  Chemically Synthesized
ucccagaagucacuugcuu

SEQ ID NO: 1963 - RNA, 19 nt, Artificial
  Chemically Synthesized
uugcuuaaaugcaaacaca

SEQ ID NO: 1964 - RNA, 19 nt, Artificial
  Chemically Synthesized
agacacuuggcagaagaug

SEQ ID NO: 1965 - RNA, 19 nt, Artificial
  Chemically Synthesized
cugaguacaaagucgugcc

SEQ ID NO: 1966 - RNA, 19 nt, Artificial
  Chemically Synthesized
acaaaaggcaaaugugccc

SEQ ID NO: 1967 - RNA, 19 nt, Artificial
  Chemically Synthesized
cuuaaaugcaaacacagaa

SEQ ID NO: 1968 - RNA, 19 nt, Artificial
  Chemically Synthesized
ucagacacuuggcagaaga

SEQ ID NO: 1969 - RNA, 19 nt, Artificial
  Chemically Synthesized
cuucacaaaaggcaaaugu

SEQ ID NO: 1970 - RNA, 19 nt, Artificial
  Chemically Synthesized
ugcucgaugcugcuguuga

SEQ ID NO: 1971 - RNA, 19 nt, Artificial
  Chemically Synthesized
cccugauuguccuaaaacg

SEQ ID NO: 1972 - RNA, 19 nt, Artificial
  Chemically Synthesized
ccuuuaaggaucauagugg

SEQ ID NO: 1973 - RNA, 19 nt, Artificial
  Chemically Synthesized
ugauuguccuaaaacggca

SEQ ID NO: 1974 - RNA, 19 nt, Artificial
  Chemically Synthesized
ugugcuucagguagcugac

SEQ ID NO: 1975 - RNA, 19 nt, Artificial
  Chemically Synthesized
ugaggauacagcucgaguu

SEQ ID NO: 1976 - RNA, 19 nt, Artificial
  Chemically Synthesized
aaaaggcaaaugugcccgc

SEQ ID NO: 1977 - RNA, 19 nt, Artificial
  Chemically Synthesized
aagaaaguccucuacaggu

SEQ ID NO: 1978 - RNA, 19 nt, Artificial
  Chemically Synthesized
auuguccuaaaacggcagg

SEQ ID NO: 1979 - RNA, 19 nt, Artificial
  Chemically Synthesized
uccuaaaacggcagggacu

SEQ ID NO: 1980 - RNA, 19 nt, Artificial
  Chemically Synthesized
ugaagaaaguccucuacag

SEQ ID NO: 1981 - RNA, 19 nt, Artificial
  Chemically Synthesized
acugagaguucaauuucug

SEQ ID NO: 1982 - RNA, 19 nt, Artificial
  Chemically Synthesized
acagaggaauccuuuaagg

SEQ ID NO: 1983 - RNA, 19 nt, Artificial
  Chemically Synthesized
cagucgguuuuucucuuug

SEQ ID NO: 1984 - RNA, 19 nt, Artificial
  Chemically Synthesized
aguucggccuucacaaaag

SEQ ID NO: 1985 - RNA, 19 nt, Artificial
  Chemically Synthesized
acacauucucugagaaugg

SEQ ID NO: 1986 - RNA, 19 nt, Artificial
  Chemically Synthesized
aagugguacagcagcuuca

SEQ ID NO: 1987 - RNA, 19 nt, Artificial
  Chemically Synthesized
cccggcacuacaaauauca

SEQ ID NO: 1988 - RNA, 19 nt, Artificial
  Chemically Synthesized
acuugcuuaaaugcaaaca

SEQ ID NO: 1989 - RNA, 19 nt, Artificial
  Chemically Synthesized
agggacucugcacacacau

SEQ ID NO: 1990 - RNA, 19 nt, Artificial
  Chemically Synthesized
agcagcuucaucugcgugu

SEQ ID NO: 1991 - RNA, 19 nt, Artificial
  Chemically Synthesized
aaaguccucuacagguugg

SEQ ID NO: 1992 - RNA, 19 nt, Artificial
  Chemically Synthesized
aaguccucuacagguuggg

SEQ ID NO: 1993 - RNA, 19 nt, Artificial
  Chemically Synthesized
aagaugggcccugauuguc

SEQ ID NO: 1994 - RNA, 19 nt, Artificial
  Chemically Synthesized
ugaucacuguuuccuauga

SEQ ID NO: 1995 - RNA, 19 nt, Artificial
  Chemically Synthesized
cggcacuacaaauaucaua

SEQ ID NO: 1996 - RNA, 19 nt, Artificial
  Chemically Synthesized
aaggcuuugcugugcuuca

SEQ ID NO: 1997 - RNA, 19 nt, Artificial
  Chemically Synthesized
aucauaguggaggcaccca

SEQ ID NO: 1998 - RNA, 19 nt, Artificial
  Chemically Synthesized
cuugcuuaaaugcaaacac

SEQ ID NO: 1999 - RNA, 19 nt, Artificial
  Chemically Synthesized
gacacuuggcagaagaugg

SEQ ID NO: 2000 - RNA, 19 nt, Artificial
  Chemically Synthesized
cugagaguucaauuucuga

SEQ ID NO: 2001 - RNA, 19 nt, Artificial
  Chemically Synthesized
ucaggagccuuuuggccau

SEQ ID NO: 2002 - RNA, 19 nt, Artificial
  Chemically Synthesized
acuguuuccuaugaggaua

SEQ ID NO: 2003 - RNA, 19 nt, Artificial
  Chemically Synthesized
uacgggcccugaagaaagu

SEQ ID NO: 2004 - RNA, 19 nt, Artificial
  Chemically Synthesized
cacaaaaggcaaaugugcc

SEQ ID NO: 2005 - RNA, 19 nt, Artificial
  Chemically Synthesized
cucgaugcugcuguugaug

SEQ ID NO: 2006 - RNA, 19 nt, Artificial
  Chemically Synthesized
aagucacuugcuuaaaugc

SEQ ID NO: 2007 - RNA, 19 nt, Artificial
  Chemically Synthesized
acgaguagccuucgcugua

SEQ ID NO: 2008 - RNA, 19 nt, Artificial
  Chemically Synthesized
aguagccuucgcuguaguc

SEQ ID NO: 2009 - RNA, 19 nt, Artificial
  Chemically Synthesized
acacuuggcagaagauggg

SEQ ID NO: 2010 - RNA, 19 nt, Artificial
  Chemically Synthesized
gauuuuauuauggcggcuu

SEQ ID NO: 2011 - RNA, 19 nt, Artificial
  Chemically Synthesized
acccacacagaggaauccu

SEQ ID NO: 2012 - RNA, 19 nt, Artificial
  Chemically Synthesized
cacagaggaauccuuuaag

SEQ ID NO: 2013 - RNA, 19 nt, Artificial
  Chemically Synthesized
cugcacacacauucucuga

SEQ ID NO: 2014 - RNA, 19 nt, Artificial
  Chemically Synthesized
ugggcccugauuguccuaa

SEQ ID NO: 2015 - RNA, 19 nt, Artificial
  Chemically Synthesized
gaaggcuuugcugugcuuc

SEQ ID NO: 2016 - RNA, 19 nt, Artificial
  Chemically Synthesized
aguucaauuucugaguaca

SEQ ID NO: 2017 - RNA, 19 nt, Artificial
  Chemically Synthesized
aggauacagcucgaguucg

SEQ ID NO: 2018 - RNA, 19 nt, Artificial
  Chemically Synthesized
gcccugaagaaaguccucu

SEQ ID NO: 2019 - RNA, 19 nt, Artificial
  Chemically Synthesized
aggaucauaguggaggcac

SEQ ID NO: 2020 - RNA, 19 nt, Artificial
  Chemically Synthesized
cugaagaaaguccucuaca

SEQ ID NO: 2021 - RNA, 19 nt, Artificial
  Chemically Synthesized
agucacuugcuuaaaugca

SEQ ID NO: 2022 - RNA, 19 nt, Artificial
  Chemically Synthesized
cuuccgcagucgguuuuuc

SEQ ID NO: 2023 - RNA, 19 nt, Artificial
  Chemically Synthesized
gaaaguccucuacagguug

SEQ ID NO: 2024 - RNA, 19 nt, Artificial
  Chemically Synthesized
acuucccagaagucacuug

SEQ ID NO: 2025 - RNA, 19 nt, Artificial
  Chemically Synthesized
gcccugauuguccuaaaac

SEQ ID NO: 2026 - RNA, 19 nt, Artificial
  Chemically Synthesized
cagauuuuauuauggcggc

SEQ ID NO: 2027 - RNA, 19 nt, Artificial
  Chemically Synthesized
cgugacugagaguucaauu

SEQ ID NO: 2028 - RNA, 19 nt, Artificial
  Chemically Synthesized
augcugcuguugaugcggu

SEQ ID NO: 2029 - RNA, 19 nt, Artificial
  Chemically Synthesized
augggcccugauuguccua

SEQ ID NO: 2030 - RNA, 19 nt, Artificial
  Chemically Synthesized
cuuugcugugcuucaggua

SEQ ID NO: 2031 - RNA, 19 nt, Artificial
  Chemically Synthesized
acacagaggaauccuuuaa

SEQ ID NO: 2032 - RNA, 19 nt, Artificial
  Chemically Synthesized
acagccaucuccaggaugu

SEQ ID NO: 2033 - RNA, 19 nt, Artificial
  Chemically Synthesized
uguccuaaaacggcaggga

SEQ ID NO: 2034 - RNA, 19 nt, Artificial
  Chemically Synthesized
cacacauucucugagaaug

SEQ ID NO: 2035 - RNA, 19 nt, Artificial
  Chemically Synthesized
agguagcugacagccaucu

SEQ ID NO: 2036 - RNA, 19 nt, Artificial
  Chemically Synthesized
cacacucaggagccuuuug

SEQ ID NO: 2037 - RNA, 19 nt, Artificial
  Chemically Synthesized
ccugaagaaaguccucuac

SEQ ID NO: 2038 - RNA, 19 nt, Artificial
  Chemically Synthesized
gaagaaaguccucuacagg

SEQ ID NO: 2039 - RNA, 19 nt, Artificial
  Chemically Synthesized
ucacuugcuuaaaugcaaa

SEQ ID NO: 2040 - RNA, 19 nt, Artificial
  Chemically Synthesized
ccgcagucgguuuuucucu

SEQ ID NO: 2041 - RNA, 19 nt, Artificial
  Chemically Synthesized
guacagcagcuucaucugc

SEQ ID NO: 2042 - RNA, 19 nt, Artificial
  Chemically Synthesized
acgaaggcuuugcugugcu

SEQ ID NO: 2043 - RNA, 19 nt, Artificial
  Chemically Synthesized
caauuucugaguacaaagu

SEQ ID NO: 2044 - RNA, 19 nt, Artificial
  Chemically Synthesized
aguacaaagucgugcccac

SEQ ID NO: 2045 - RNA, 19 nt, Artificial
  Chemically Synthesized
gaggaauccuuuaaggauc

SEQ ID NO: 2046 - RNA, 19 nt, Artificial
  Chemically Synthesized
cuuuaaggaucauagugga

SEQ ID NO: 2047 - RNA, 19 nt, Artificial
  Chemically Synthesized
gaucacuguuuccuaugag

SEQ ID NO: 2048 - RNA, 19 nt, Artificial
  Chemically Synthesized
guuuccuaugaggauacag

SEQ ID NO: 2049 - RNA, 19 nt, Artificial
  Chemically Synthesized
gguacagcagcuucaucug

SEQ ID NO: 2050 - RNA, 19 nt, Artificial
  Chemically Synthesized
auccuuuaaggaucauagu

SEQ ID NO: 2051 - RNA, 19 nt, Artificial
  Chemically Synthesized
cuguuuccuaugaggauac

SEQ ID NO: 2052 - RNA, 19 nt, Artificial
  Chemically Synthesized
agaaaguccucuacagguu

SEQ ID NO: 2053 - RNA, 19 nt, Artificial
  Chemically Synthesized
cuaaaacggcagggacucu

SEQ ID NO: 2054 - RNA, 19 nt, Artificial
  Chemically Synthesized
gaagugguacagcagcuuc

SEQ ID NO: 2055 - RNA, 19 nt, Artificial
  Chemically Synthesized
acagcagcuucaucugcgu

SEQ ID NO: 2056 - RNA, 19 nt, Artificial
  Chemically Synthesized
agauuuuauuauggcggcu

SEQ ID NO: 2057 - RNA, 19 nt, Artificial
  Chemically Synthesized
cuucuccagcuuggaguug

SEQ ID NO: 2058 - RNA, 19 nt, Artificial
  Chemically Synthesized
ugcugugcuucagguagcu

SEQ ID NO: 2059 - RNA, 19 nt, Artificial
  Chemically Synthesized
uccacccacacagaggaau

SEQ ID NO: 2060 - RNA, 19 nt, Artificial
  Chemically Synthesized
gaguucggccuucacaaaa

SEQ ID NO: 2061 - RNA, 19 nt, Artificial
  Chemically Synthesized
aggcuuugcugugcuucag

SEQ ID NO: 2062 - RNA, 19 nt, Artificial
  Chemically Synthesized
acgugacugagaguucaau

SEQ ID NO: 2063 - RNA, 19 nt, Artificial
  Chemically Synthesized
aaaugcaaacacagaacaa

SEQ ID NO: 2064 - RNA, 19 nt, Artificial
  Chemically Synthesized
gacucugcacacacauucu

SEQ ID NO: 2065 - RNA, 19 nt, Artificial
  Chemically Synthesized
gugguacagcagcuucauc

SEQ ID NO: 2066 - RNA, 19 nt, Artificial
  Chemically Synthesized
guacaaagucgugcccaca

SEQ ID NO: 2067 - RNA, 19 nt, Artificial
  Chemically Synthesized
gaagucacuugcuuaaaug

SEQ ID NO: 2068 - RNA, 19 nt, Artificial
  Chemically Synthesized
gggcugaacaaucagauuu

SEQ ID NO: 2069 - RNA, 19 nt, Artificial
  Chemically Synthesized
gugacugagaguucaauuu

SEQ ID NO: 2070 - RNA, 19 nt, Artificial
  Chemically Synthesized
guucggccuucacaaaagg

SEQ ID NO: 2071 - RNA, 19 nt, Artificial
  Chemically Synthesized
gaagaugggcccugauugu

SEQ ID NO: 2072 - RNA, 19 nt, Artificial
  Chemically Synthesized
cacauucucugagaauggg

SEQ ID NO: 2073 - RNA, 19 nt, Artificial
  Chemically Synthesized
cgcagucgguuuuucucuu

SEQ ID NO: 2074 - RNA, 19 nt, Artificial
  Chemically Synthesized
ccacacagaggaauccuuu

SEQ ID NO: 2075 - RNA, 19 nt, Artificial
  Chemically Synthesized
agaggaauccuuuaaggau

SEQ ID NO: 2076 - RNA, 19 nt, Artificial
  Chemically Synthesized
aaggaucauaguggaggca

SEQ ID NO: 2077 - RNA, 19 nt, Artificial
  Chemically Synthesized
ccggcacuacaaauaucau

SEQ ID NO: 2078 - RNA, 19 nt, Artificial
  Chemically Synthesized
agaagucacuugcuuaaau

SEQ ID NO: 2079 - RNA, 19 nt, Artificial
  Chemically Synthesized
ccagaagucacuugcuuaa

SEQ ID NO: 2080 - RNA, 19 nt, Artificial
  Chemically Synthesized
cacuugcuuaaaugcaaac

SEQ ID NO: 2081 - RNA, 19 nt, Artificial
  Chemically Synthesized
gauuguccuaaaacggcag

SEQ ID NO: 2082 - RNA, 19 nt, Artificial
  Chemically Synthesized
gcuuugcugugcuucaggu

SEQ ID NO: 2083 - RNA, 19 nt, Artificial
  Chemically Synthesized
gcacacucaggagccuuuu

SEQ ID NO: 2084 - RNA, 19 nt, Artificial
  Chemically Synthesized
cccagaagucacuugcuua

SEQ ID NO: 2085 - RNA, 19 nt, Artificial
  Chemically Synthesized
cagaagaugggcccugauu

SEQ ID NO: 2086 - RNA, 19 nt, Artificial
  Chemically Synthesized
gagaguucaauuucugagu

SEQ ID NO: 2087 - RNA, 19 nt, Artificial
  Chemically Synthesized
gaggauacagcucgaguuc

SEQ ID NO: 2088 - RNA, 19 nt, Artificial
  Chemically Synthesized
agugguacagcagcuucau

SEQ ID NO: 2089 - RNA, 19 nt, Artificial
  Chemically Synthesized
guucaauuucugaguacaa

SEQ ID NO: 2090 - RNA, 19 nt, Artificial
  Chemically Synthesized
gaguacaaagucgugccca

SEQ ID NO: 2091 - RNA, 19 nt, Artificial
  Chemically Synthesized
gcacuacaaauaucauaga

SEQ ID NO: 2092 - RNA, 19 nt, Artificial
  Chemically Synthesized
gucacuugcuuaaaugcaa

SEQ ID NO: 2093 - RNA, 19 nt, Artificial
  Chemically Synthesized
gcagucgguuuuucucuuu

SEQ ID NO: 2094 - RNA, 19 nt, Artificial
  Chemically Synthesized
cuaugaggauacagcucga

SEQ ID NO: 2095 - RNA, 19 nt, Artificial
  Chemically Synthesized
cccugaagaaaguccucua

SEQ ID NO: 2096 - RNA, 19 nt, Artificial
  Chemically Synthesized
gugcuucagguagcugaca

SEQ ID NO: 2097 - RNA, 19 nt, Artificial
  Chemically Synthesized
gacugagaguucaauuucu

SEQ ID NO: 2098 - RNA, 19 nt, Artificial
  Chemically Synthesized
aggaauccuuuaaggauca

SEQ ID NO: 2099 - RNA, 19 nt, Artificial
  Chemically Synthesized
ugacagccaucuccaggau

SEQ ID NO: 2100 - RNA, 19 nt, Artificial
  Chemically Synthesized
acacacauucucugagaau

SEQ ID NO: 2101 - RNA, 19 nt, Artificial
  Chemically Synthesized
cagaggaauccuuuaagga

SEQ ID NO: 2102 - RNA, 19 nt, Artificial
  Chemically Synthesized
gaauccuuuaaggaucaua

SEQ ID NO: 2103 - RNA, 19 nt, Artificial
  Chemically Synthesized
uguuuccuaugaggauaca

SEQ ID NO: 2104 - RNA, 19 nt, Artificial
  Chemically Synthesized
gcacacacauucucugaga

SEQ ID NO: 2105 - RNA, 19 nt, Artificial
  Chemically Synthesized
ccacgugacugagaguuca

SEQ ID NO: 2106 - RNA, 19 nt, Artificial
  Chemically Synthesized
gaguucaauuucugaguac

SEQ ID NO: 2107 - RNA, 19 nt, Artificial
  Chemically Synthesized
ggcugaacaaucagauuuu

SEQ ID NO: 2108 - RNA, 19 nt, Artificial
  Chemically Synthesized
gggacucugcacacacauu

SEQ ID NO: 2109 - RNA, 19 nt, Artificial
  Chemically Synthesized
gaguagccuucgcuguagu

SEQ ID NO: 2110 - RNA, 19 nt, Artificial
  Chemically Synthesized
cccacacagaggaauccuu

SEQ ID NO: 2111 - RNA, 19 nt, Artificial
  Chemically Synthesized
cacacagaggaauccuuua

SEQ ID NO: 2112 - RNA, 19 nt, Artificial
  Chemically Synthesized
gggugaucacuguuuccua

SEQ ID NO: 2113 - RNA, 19 nt, Artificial
  Chemically Synthesized
cggccuucacaaaaggcaa

SEQ ID NO: 2114 - RNA, 19 nt, Artificial
  Chemically Synthesized
gcuuaaaugcaaacacaga

SEQ ID NO: 2115 - RNA, 19 nt, Artificial
  Chemically Synthesized
gcuuccgcagucgguuuuu

SEQ ID NO: 2116 - RNA, 19 nt, Artificial
  Chemically Synthesized
ccuucuccagcuuggaguu

SEQ ID NO: 2117 - RNA, 19 nt, Artificial
  Chemically Synthesized
ccuucacaaaaggcaaaug

SEQ ID NO: 2118 - RNA, 19 nt, Artificial
  Chemically Synthesized
cuuccacgugacugagagu

SEQ ID NO: 2119 - RNA, 19 nt, Artificial
  Chemically Synthesized
agaguucaauuucugagua

SEQ ID NO: 2120 - RNA, 19 nt, Artificial
  Chemically Synthesized
cagaagucacuugcuuaaa

SEQ ID NO: 2121 - RNA, 19 nt, Artificial
  Chemically Synthesized
ggacuucccagaagucacu

SEQ ID NO: 2122 - RNA, 19 nt, Artificial
  Chemically Synthesized
gacuucccagaagucacuu

SEQ ID NO: 2123 - RNA, 19 nt, Artificial
  Chemically Synthesized
ggaagugguacagcagcuu

SEQ ID NO: 2124 - RNA, 19 nt, Artificial
  Chemically Synthesized
auccacccacacagaggaa

SEQ ID NO: 2125 - RNA, 19 nt, Artificial
  Chemically Synthesized
cacuguuuccuaugaggau

SEQ ID NO: 2126 - RNA, 19 nt, Artificial
  Chemically Synthesized
cacacacauucucugagaa

SEQ ID NO: 2127 - RNA, 19 nt, Artificial
  Chemically Synthesized
ggugaucacuguuuccuau

SEQ ID NO: 2128 - RNA, 19 nt, Artificial
  Chemically Synthesized
cacgugacugagaguucaa

SEQ ID NO: 2129 - RNA, 19 nt, Artificial
  Chemically Synthesized
gccuucacaaaaggcaaau

SEQ ID NO: 2130 - RNA, 19 nt, Artificial
  Chemically Synthesized
gucagacacuuggcagaag

SEQ ID NO: 2131 - RNA, 19 nt, Artificial
  Chemically Synthesized
gcucgaugcugcuguugau

SEQ ID NO: 2132 - RNA, 19 nt, Artificial
  Chemically Synthesized
cagacacuuggcagaagau

SEQ ID NO: 2133 - RNA, 19 nt, Artificial
  Chemically Synthesized
ggcccugauuguccuaaaa

SEQ ID NO: 2134 - RNA, 19 nt, Artificial
  Chemically Synthesized
cgaaggcuuugcugugcuu

SEQ ID NO: 2135 - RNA, 19 nt, Artificial
  Chemically Synthesized
ggucagacacuuggcagaa

SEQ ID NO: 2136 - RNA, 19 nt, Artificial
  Chemically Synthesized
cgaguucggccuucacaaa

SEQ ID NO: 2137 - RNA, 19 nt, Artificial
  Chemically Synthesized
gggcccugauuguccuaaa

SEQ ID NO: 2138 - RNA, 19 nt, Artificial
  Chemically Synthesized
gcugaacaaucagauuuua

SEQ ID NO: 2139 - RNA, 19 nt, Artificial
  Chemically Synthesized
ggccuucacaaaaggcaaa

SEQ ID NO: 2140 - RNA, 19 nt, Artificial
  Chemically Synthesized
ggaauccuuuaaggaucau

SEQ ID NO: 2141 - RNA, 19 nt, Artificial
  Chemically Synthesized
caaugaucaccgacugaaa

SEQ ID NO: 2142 - RNA, 19 nt, Artificial
  Chemically Synthesized
cggaucugagggagaacaa

SEQ ID NO: 2143 - RNA, 19 nt, Artificial
  Chemically Synthesized
agguaaacgugcugcucua

SEQ ID NO: 2144 - RNA, 19 nt, Artificial
  Chemically Synthesized
uggacgagcagcagguaaa

SEQ ID NO: 2145 - RNA, 19 nt, Artificial
  Chemically Synthesized
gcugaacucggaauccgaa

SEQ ID NO: 2146 - RNA, 19 nt, Artificial
  Chemically Synthesized
guuggagcugaacucggaa

SEQ ID NO: 2147 - RNA, 19 nt, Artificial
  Chemically Synthesized
cguucuuaacuguuccauu

SEQ ID NO: 2148 - RNA, 19 nt, Artificial
  Chemically Synthesized
aguuggagcugaacucgga

SEQ ID NO: 2149 - RNA, 19 nt, Artificial
  Chemically Synthesized
aaugaucaccgacugaaaa

SEQ ID NO: 2150 - RNA, 19 nt, Artificial
  Chemically Synthesized
gagggagaacaagaccgau

SEQ ID NO: 2151 - RNA, 19 nt, Artificial
  Chemically Synthesized
gaucugagggagaacaaga

SEQ ID NO: 2152 - RNA, 19 nt, Artificial
  Chemically Synthesized
cagucgccaagaaucauga

SEQ ID NO: 2153 - RNA, 19 nt, Artificial
  Chemically Synthesized
agucgccaagaaucaugaa

SEQ ID NO: 2154 - RNA, 19 nt, Artificial
  Chemically Synthesized
ggaucugagggagaacaag

SEQ ID NO: 2155 - RNA, 19 nt, Artificial
  Chemically Synthesized
acuacaucagggaccuuca

SEQ ID NO: 2156 - RNA, 19 nt, Artificial
  Chemically Synthesized
ugcugcucuacgacaugaa

SEQ ID NO: 2157 - RNA, 19 nt, Artificial
  Chemically Synthesized
ugagggagaacaagaccga

SEQ ID NO: 2158 - RNA, 19 nt, Artificial
  Chemically Synthesized
gcuuccaccucauuuuuuu

SEQ ID NO: 2159 - RNA, 19 nt, Artificial
  Chemically Synthesized
cgcaucuugugucgcugaa

SEQ ID NO: 2160 - RNA, 19 nt, Artificial
  Chemically Synthesized
agcugaacucggaauccga

SEQ ID NO: 2161 - RNA, 19 nt, Artificial
  Chemically Synthesized
gggcuguuuuuuuguuauu

SEQ ID NO: 2162 - RNA, 19 nt, Artificial
  Chemically Synthesized
agguggagauucuccagca

SEQ ID NO: 2163 - RNA, 19 nt, Artificial
  Chemically Synthesized
gcaagguggagauucucca

SEQ ID NO: 2164 - RNA, 19 nt, Artificial
  Chemically Synthesized
aggugagcaagguggagau

SEQ ID NO: 2165 - RNA, 19 nt, Artificial
  Chemically Synthesized
gccagucgccaagaaucau

SEQ ID NO: 2166 - RNA, 19 nt, Artificial
  Chemically Synthesized
acguuuggugcuucucaga

SEQ ID NO: 2167 - RNA, 19 nt, Artificial
  Chemically Synthesized
cacguuuggugcuucucag

SEQ ID NO: 2168 - RNA, 19 nt, Artificial
  Chemically Synthesized
cucggaauccgaaguugga

SEQ ID NO: 2169 - RNA, 19 nt, Artificial
  Chemically Synthesized
auauuacaaugaucaccga

SEQ ID NO: 2170 - RNA, 19 nt, Artificial
  Chemically Synthesized
ccauuuuccguaucugcuu

SEQ ID NO: 2171 - RNA, 19 nt, Artificial
  Chemically Synthesized
cuuugcccauucuguuuca

SEQ ID NO: 2172 - RNA, 19 nt, Artificial
  Chemically Synthesized
cguuuggugcuucucagau

SEQ ID NO: 2173 - RNA, 19 nt, Artificial
  Chemically Synthesized
gagauucuccagcacguca

SEQ ID NO: 2174 - RNA, 19 nt, Artificial
  Chemically Synthesized
gucgccaagaaucaugaaa

SEQ ID NO: 2175 - RNA, 19 nt, Artificial
  Chemically Synthesized
gaucaccgacugaaaauau

SEQ ID NO: 2176 - RNA, 19 nt, Artificial
  Chemically Synthesized
ccucucugcacaccuacua

SEQ ID NO: 2177 - RNA, 19 nt, Artificial
  Chemically Synthesized
caagaaucaugaaagucgc

SEQ ID NO: 2178 - RNA, 19 nt, Artificial
  Chemically Synthesized
cgcuuugcccauucuguuu

SEQ ID NO: 2179 - RNA, 19 nt, Artificial
  Chemically Synthesized
uucucagauuucugaggaa

SEQ ID NO: 2180 - RNA, 19 nt, Artificial
  Chemically Synthesized
accuucaguuggagcugaa

SEQ ID NO: 2181 - RNA, 19 nt, Artificial
  Chemically Synthesized
gcuguuacucacgccucaa

SEQ ID NO: 2182 - RNA, 19 nt, Artificial
  Chemically Synthesized
ugaucaccgacugaaaaua

SEQ ID NO: 2183 - RNA, 19 nt, Artificial
  Chemically Synthesized
acaccuacuagucaccaga

SEQ ID NO: 2184 - RNA, 19 nt, Artificial
  Chemically Synthesized
gaaucaugaaagucgccag

SEQ ID NO: 2185 - RNA, 19 nt, Artificial
  Chemically Synthesized
cgggcuuccaccucauuuu

SEQ ID NO: 2186 - RNA, 19 nt, Artificial
  Chemically Synthesized
agaaccgcaaggugagcaa

SEQ ID NO: 2187 - RNA, 19 nt, Artificial
  Chemically Synthesized
ggaauuacgugcucugugg

SEQ ID NO: 2188 - RNA, 19 nt, Artificial
  Chemically Synthesized
guuacucacgccucaagga

SEQ ID NO: 2189 - RNA, 19 nt, Artificial
  Chemically Synthesized
guucuuaacuguuccauuu

SEQ ID NO: 2190 - RNA, 19 nt, Artificial
  Chemically Synthesized
agauucuccagcacgucau

SEQ ID NO: 2191 - RNA, 19 nt, Artificial
  Chemically Synthesized
acgacaugaacggcuguua

SEQ ID NO: 2192 - RNA, 19 nt, Artificial
  Chemically Synthesized
ccgacugaaaauauuguuu

SEQ ID NO: 2193 - RNA, 19 nt, Artificial
  Chemically Synthesized
caccgacugaaaauauugu

SEQ ID NO: 2194 - RNA, 19 nt, Artificial
  Chemically Synthesized
acaaugaucaccgacugaa

SEQ ID NO: 2195 - RNA, 19 nt, Artificial
  Chemically Synthesized
cucagauuucugaggaaau

SEQ ID NO: 2196 - RNA, 19 nt, Artificial
  Chemically Synthesized
aacuguuccauuuuccgua

SEQ ID NO: 2197 - RNA, 19 nt, Artificial
  Chemically Synthesized
ucgcuuugcccauucuguu

SEQ ID NO: 2198 - RNA, 19 nt, Artificial
  Chemically Synthesized
gggcaagaggaauuacgug

SEQ ID NO: 2199 - RNA, 19 nt, Artificial
  Chemically Synthesized
gcaucuugugucgcugaag

SEQ ID NO: 2200 - RNA, 19 nt, Artificial
  Chemically Synthesized
cgacuacaucagggaccuu

SEQ ID NO: 2201 - RNA, 19 nt, Artificial
  Chemically Synthesized
ucaucgacuacaucaggga

SEQ ID NO: 2202 - RNA, 19 nt, Artificial
  Chemically Synthesized
ggugagcaagguggagauu

SEQ ID NO: 2203 - RNA, 19 nt, Artificial
  Chemically Synthesized
cuacgacaugaacggcugu

SEQ ID NO: 2204 - RNA, 19 nt, Artificial
  Chemically Synthesized
cucguguguuucuauuuuu

SEQ ID NO: 2205 - RNA, 19 nt, Artificial
  Chemically Synthesized
uaaacgugcugcucuacga

SEQ ID NO: 2206 - RNA, 19 nt, Artificial
  Chemically Synthesized
ccaccucauuuuuuucgcu

SEQ ID NO: 2207 - RNA, 19 nt, Artificial
  Chemically Synthesized
gaggaauuacgugcucugu

SEQ ID NO: 2208 - RNA, 19 nt, Artificial
  Chemically Synthesized
ucggaauccgaaguuggaa

SEQ ID NO: 2209 - RNA, 19 nt, Artificial
  Chemically Synthesized
cuacaucagggaccuucag

SEQ ID NO: 2210 - RNA, 19 nt, Artificial
  Chemically Synthesized
uguuucagccagucgccaa

SEQ ID NO: 2211 - RNA, 19 nt, Artificial
  Chemically Synthesized
cacguucuuaacuguucca

SEQ ID NO: 2212 - RNA, 19 nt, Artificial
  Chemically Synthesized
gggcuuccaccucauuuuu

SEQ ID NO: 2213 - RNA, 19 nt, Artificial
  Chemically Synthesized
acuguuccauuuuccguau

SEQ ID NO: 2214 - RNA, 19 nt, Artificial
  Chemically Synthesized
uggagauucuccagcacgu

SEQ ID NO: 2215 - RNA, 19 nt, Artificial
  Chemically Synthesized
agccagucgccaagaauca

SEQ ID NO: 2216 - RNA, 19 nt, Artificial
  Chemically Synthesized
cuagucaccagagacuuua

SEQ ID NO: 2217 - RNA, 19 nt, Artificial
  Chemically Synthesized
uacaaugaucaccgacuga

SEQ ID NO: 2218 - RNA, 19 nt, Artificial
  Chemically Synthesized
acucguguguuucuauuuu

SEQ ID NO: 2219 - RNA, 19 nt, Artificial
  Chemically Synthesized
acgugcugcucuacgacau

SEQ ID NO: 2220 - RNA, 19 nt, Artificial
  Chemically Synthesized
ccauucuguuucagccagu

SEQ ID NO: 2221 - RNA, 19 nt, Artificial
  Chemically Synthesized
ccacguucuuaacuguucc

SEQ ID NO: 2222 - RNA, 19 nt, Artificial
  Chemically Synthesized
aucaccgacugaaaauauu

SEQ ID NO: 2223 - RNA, 19 nt, Artificial
  Chemically Synthesized
accuacuagucaccagaga

SEQ ID NO: 2224 - RNA, 19 nt, Artificial
  Chemically Synthesized
cucucugcacaccuacuag

SEQ ID NO: 2225 - RNA, 19 nt, Artificial
  Chemically Synthesized
cggaauccgaaguuggaac

SEQ ID NO: 2226 - RNA, 19 nt, Artificial
  Chemically Synthesized
gauucuccagcacgucauc

SEQ ID NO: 2227 - RNA, 19 nt, Artificial
  Chemically Synthesized
caagguggagauucuccag

SEQ ID NO: 2228 - RNA, 19 nt, Artificial
  Chemically Synthesized
gcugcucuacgacaugaac

SEQ ID NO: 2229 - RNA, 19 nt, Artificial
  Chemically Synthesized
ucagccagucgccaagaau

SEQ ID NO: 2230 - RNA, 19 nt, Artificial
  Chemically Synthesized
gugcuucucagauuucuga

SEQ ID NO: 2231 - RNA, 19 nt, Artificial
  Chemically Synthesized
acuagucaccagagacuuu

SEQ ID NO: 2232 - RNA, 19 nt, Artificial
  Chemically Synthesized
gcccauucuguuucagcca

SEQ ID NO: 2233 - RNA, 19 nt, Artificial
  Chemically Synthesized
accucauuuuuuucgcuuu

SEQ ID NO: 2234 - RNA, 19 nt, Artificial
  Chemically Synthesized
uggugcuucucagauuucu

SEQ ID NO: 2235 - RNA, 19 nt, Artificial
  Chemically Synthesized
ucaugaaagucgccagugg

SEQ ID NO: 2236 - RNA, 19 nt, Artificial
  Chemically Synthesized
augaucaccgacugaaaau

SEQ ID NO: 2237 - RNA, 19 nt, Artificial
  Chemically Synthesized
ucucagauuucugaggaaa

SEQ ID NO: 2238 - RNA, 19 nt, Artificial
  Chemically Synthesized
ucacguuuggugcuucuca

SEQ ID NO: 2239 - RNA, 19 nt, Artificial
  Chemically Synthesized
aaaaaauggucacguuugg

SEQ ID NO: 2240 - RNA, 19 nt, Artificial
  Chemically Synthesized
cguguguuucuauuuuuug

SEQ ID NO: 2241 - RNA, 19 nt, Artificial
  Chemically Synthesized
ucgcaucuugugucgcuga

SEQ ID NO: 2242 - RNA, 19 nt, Artificial
  Chemically Synthesized
caucgacuacaucagggac

SEQ ID NO: 2243 - RNA, 19 nt, Artificial
  Chemically Synthesized
gagcaagguggagauucuc

SEQ ID NO: 2244 - RNA, 19 nt, Artificial
  Chemically Synthesized
ucgccaagaaucaugaaag

SEQ ID NO: 2245 - RNA, 19 nt, Artificial
  Chemically Synthesized
ccucauuuuuuucgcuuug

SEQ ID NO: 2246 - RNA, 19 nt, Artificial
  Chemically Synthesized
uccacucguguguuucuau

SEQ ID NO: 2247 - RNA, 19 nt, Artificial
  Chemically Synthesized
gggauuccacucguguguu

SEQ ID NO: 2248 - RNA, 19 nt, Artificial
  Chemically Synthesized
cacaccuacuagucaccag

SEQ ID NO: 2249 - RNA, 19 nt, Artificial
  Chemically Synthesized
agcacgucaucgacuacau

SEQ ID NO: 2250 - RNA, 19 nt, Artificial
  Chemically Synthesized
ccaagaaucaugaaagucg

SEQ ID NO: 2251 - RNA, 19 nt, Artificial
  Chemically Synthesized
uuuuuuucgcuuugcccau

SEQ ID NO: 2252 - RNA, 19 nt, Artificial
  Chemically Synthesized
guuuuacaauaguucugug

SEQ ID NO: 2253 - RNA, 19 nt, Artificial
  Chemically Synthesized
gauuucugaggaaauugcu

SEQ ID NO: 2254 - RNA, 19 nt, Artificial
  Chemically Synthesized
ggugcuucucagauuucug

SEQ ID NO: 2255 - RNA, 19 nt, Artificial
  Chemically Synthesized
auuccacguucuuaacugu

SEQ ID NO: 2256 - RNA, 19 nt, Artificial
  Chemically Synthesized
aaucaugaaagucgccagu

SEQ ID NO: 2257 - RNA, 19 nt, Artificial
  Chemically Synthesized
ccagucgccaagaaucaug

SEQ ID NO: 2258 - RNA, 19 nt, Artificial
  Chemically Synthesized
auuuuuuucgcuuugccca

SEQ ID NO: 2259 - RNA, 19 nt, Artificial
  Chemically Synthesized
cuucucagauuucugagga

SEQ ID NO: 2260 - RNA, 19 nt, Artificial
  Chemically Synthesized
uccucucugcacaccuacu

SEQ ID NO: 2261 - RNA, 19 nt, Artificial
  Chemically Synthesized
caagaggaauuacgugcuc

SEQ ID NO: 2262 - RNA, 19 nt, Artificial
  Chemically Synthesized
gaccuucaguuggagcuga

SEQ ID NO: 2263 - RNA, 19 nt, Artificial
  Chemically Synthesized
acaucagggaccuucaguu

SEQ ID NO: 2264 - RNA, 19 nt, Artificial
  Chemically Synthesized
cacgucaucgacuacauca

SEQ ID NO: 2265 - RNA, 19 nt, Artificial
  Chemically Synthesized
ucagauuucugaggaaauu

SEQ ID NO: 2266 - RNA, 19 nt, Artificial
  Chemically Synthesized
acugcgcccuuaacugcau

SEQ ID NO: 2267 - RNA, 19 nt, Artificial
  Chemically Synthesized
uucagccagucgccaagaa

SEQ ID NO: 2268 - RNA, 19 nt, Artificial
  Chemically Synthesized
gcaagaggaauuacgugcu

SEQ ID NO: 2269 - RNA, 19 nt, Artificial
  Chemically Synthesized
caccucauuuuuuucgcuu

SEQ ID NO: 2270 - RNA, 19 nt, Artificial
  Chemically Synthesized
accgacugaaaauauuguu

SEQ ID NO: 2271 - RNA, 19 nt, Artificial
  Chemically Synthesized
aucugagggagaacaagac

SEQ ID NO: 2272 - RNA, 19 nt, Artificial
  Chemically Synthesized
ccuucaguuggagcugaac

SEQ ID NO: 2273 - RNA, 19 nt, Artificial
  Chemically Synthesized
ucgacuacaucagggaccu

SEQ ID NO: 2274 - RNA, 19 nt, Artificial
  Chemically Synthesized
gguaaacgugcugcucuac

SEQ ID NO: 2275 - RNA, 19 nt, Artificial
  Chemically Synthesized
aggaauuacgugcucugug

SEQ ID NO: 2276 - RNA, 19 nt, Artificial
  Chemically Synthesized
uucuccagcacgucaucga

SEQ ID NO: 2277 - RNA, 19 nt, Artificial
  Chemically Synthesized
augaaagucgccaguggca

SEQ ID NO: 2278 - RNA, 19 nt, Artificial
  Chemically Synthesized
uucgcuuugcccauucugu

SEQ ID NO: 2279 - RNA, 19 nt, Artificial
  Chemically Synthesized
ggcuuccaccucauuuuuu

SEQ ID NO: 2280 - RNA, 19 nt, Artificial
  Chemically Synthesized
cacucguguguuucuauuu

SEQ ID NO: 2281 - RNA, 19 nt, Artificial
  Chemically Synthesized
cgucaucgacuacaucagg

SEQ ID NO: 2282 - RNA, 19 nt, Artificial
  Chemically Synthesized
cagguaaacgugcugcucu

SEQ ID NO: 2283 - RNA, 19 nt, Artificial
  Chemically Synthesized
ccuacuagucaccagagac

SEQ ID NO: 2284 - RNA, 19 nt, Artificial
  Chemically Synthesized
ucugcacaccuacuaguca

SEQ ID NO: 2285 - RNA, 19 nt, Artificial
  Chemically Synthesized
gaauuacgugcucuguggg

SEQ ID NO: 2286 - RNA, 19 nt, Artificial
  Chemically Synthesized
acgagcagcagguaaacgu

SEQ ID NO: 2287 - RNA, 19 nt, Artificial
  Chemically Synthesized
ucaccgacugaaaauauug

SEQ ID NO: 2288 - RNA, 19 nt, Artificial
  Chemically Synthesized
gaucgcaucuugugucgcu

SEQ ID NO: 2289 - RNA, 19 nt, Artificial
  Chemically Synthesized
uccauuuuccguaucugcu

SEQ ID NO: 2290 - RNA, 19 nt, Artificial
  Chemically Synthesized
guuccauuuuccguaucug

SEQ ID NO: 2291 - RNA, 19 nt, Artificial
  Chemically Synthesized
uguuccauuuuccguaucu

SEQ ID NO: 2292 - RNA, 19 nt, Artificial
  Chemically Synthesized
ucuacgacaugaacggcug

SEQ ID NO: 2293 - RNA, 19 nt, Artificial
  Chemically Synthesized
aaaaauggucacguuuggu

SEQ ID NO: 2294 - RNA, 19 nt, Artificial
  Chemically Synthesized
uuacgugcucugugggucu

SEQ ID NO: 2295 - RNA, 19 nt, Artificial
  Chemically Synthesized
cauuuuuuucgcuuugccc

SEQ ID NO: 2296 - RNA, 19 nt, Artificial
  Chemically Synthesized
uuacaaugaucaccgacug

SEQ ID NO: 2297 - RNA, 19 nt, Artificial
  Chemically Synthesized
cuacuagucaccagagacu

SEQ ID NO: 2298 - RNA, 19 nt, Artificial
  Chemically Synthesized
ugaacucggaauccgaagu

SEQ ID NO: 2299 - RNA, 19 nt, Artificial
  Chemically Synthesized
augaacggcuguuacucac

SEQ ID NO: 2300 - RNA, 19 nt, Artificial
  Chemically Synthesized
agaaucaugaaagucgcca

SEQ ID NO: 2301 - RNA, 19 nt, Artificial
  Chemically Synthesized
cauucuguuucagccaguc

SEQ ID NO: 2302 - RNA, 19 nt, Artificial
  Chemically Synthesized
gcacaccuacuagucacca

SEQ ID NO: 2303 - RNA, 19 nt, Artificial
  Chemically Synthesized
cauuuuccguaucugcuuc

SEQ ID NO: 2304 - RNA, 19 nt, Artificial
  Chemically Synthesized
cugaacucggaauccgaag

SEQ ID NO: 2305 - RNA, 19 nt, Artificial
  Chemically Synthesized
uuccacucguguguuucua

SEQ ID NO: 2306 - RNA, 19 nt, Artificial
  Chemically Synthesized
uagucaccagagacuuuag

SEQ ID NO: 2307 - RNA, 19 nt, Artificial
  Chemically Synthesized
agaggaauuacgugcucug

SEQ ID NO: 2308 - RNA, 19 nt, Artificial
  Chemically Synthesized
acgucaucgacuacaucag

SEQ ID NO: 2309 - RNA, 19 nt, Artificial
  Chemically Synthesized
aacgugcugcucuacgaca

SEQ ID NO: 2310 - RNA, 19 nt, Artificial
  Chemically Synthesized
cuuccaccucauuuuuuuc

SEQ ID NO: 2311 - RNA, 19 nt, Artificial
  Chemically Synthesized
uucgggcuuccaccucauu

SEQ ID NO: 2312 - RNA, 19 nt, Artificial
  Chemically Synthesized
ccuuaacugcauccagccu

SEQ ID NO: 2313 - RNA, 19 nt, Artificial
  Chemically Synthesized
uuggagcugaacucggaau

SEQ ID NO: 2314 - RNA, 19 nt, Artificial
  Chemically Synthesized
aaggugagcaagguggaga

SEQ ID NO: 2315 - RNA, 19 nt, Artificial
  Chemically Synthesized
cuguuacucacgccucaag

SEQ ID NO: 2316 - RNA, 19 nt, Artificial
  Chemically Synthesized
uaacuguuccauuuuccgu

SEQ ID NO: 2317 - RNA, 19 nt, Artificial
  Chemically Synthesized
cucuacgacaugaacggcu

SEQ ID NO: 2318 - RNA, 19 nt, Artificial
  Chemically Synthesized
acguucuuaacuguuccau

SEQ ID NO: 2319 - RNA, 19 nt, Artificial
  Chemically Synthesized
auuucugaggaaauugcuu

SEQ ID NO: 2320 - RNA, 19 nt, Artificial
  Chemically Synthesized
aauggucacguuuggugcu

SEQ ID NO: 2321 - RNA, 19 nt, Artificial
  Chemically Synthesized
caccuacuagucaccagag

SEQ ID NO: 2322 - RNA, 19 nt, Artificial
  Chemically Synthesized
cugcacaccuacuagucac

SEQ ID NO: 2323 - RNA, 19 nt, Artificial
  Chemically Synthesized
aauuacgugcucugugggu

SEQ ID NO: 2324 - RNA, 19 nt, Artificial
  Chemically Synthesized
ucuuaacuguuccauuuuc

SEQ ID NO: 2325 - RNA, 19 nt, Artificial
  Chemically Synthesized
auuacaaugaucaccgacu

SEQ ID NO: 2326 - RNA, 19 nt, Artificial
  Chemically Synthesized
ucgggcuuccaccucauuu

SEQ ID NO: 2327 - RNA, 19 nt, Artificial
  Chemically Synthesized
uaaaaaauggucacguuug

SEQ ID NO: 2328 - RNA, 19 nt, Artificial
  Chemically Synthesized
ugggauuccacucgugugu

SEQ ID NO: 2329 - RNA, 19 nt, Artificial
  Chemically Synthesized
cuucaguuggagcugaacu

SEQ ID NO: 2330 - RNA, 19 nt, Artificial
  Chemically Synthesized
agauuucugaggaaauugc

SEQ ID NO: 2331 - RNA, 19 nt, Artificial
  Chemically Synthesized
uuaacugcauccagccugg

SEQ ID NO: 2332 - RNA, 19 nt, Artificial
  Chemically Synthesized
acaugaacggcuguuacuc

SEQ ID NO: 2333 - RNA, 19 nt, Artificial
  Chemically Synthesized
cuuaacuguuccauuuucc

SEQ ID NO: 2334 - RNA, 19 nt, Artificial
  Chemically Synthesized
uuucagccagucgccaaga

SEQ ID NO: 2335 - RNA, 19 nt, Artificial
  Chemically Synthesized
cccauucuguuucagccag

SEQ ID NO: 2336 - RNA, 19 nt, Artificial
  Chemically Synthesized
auuccacucguguguuucu

SEQ ID NO: 2337 - RNA, 19 nt, Artificial
  Chemically Synthesized
caucuugugucgcugaagc

SEQ ID NO: 2338 - RNA, 19 nt, Artificial
  Chemically Synthesized
gaacucggaauccgaaguu

SEQ ID NO: 2339 - RNA, 19 nt, Artificial
  Chemically Synthesized
aaacgugcugcucuacgac

SEQ ID NO: 2340 - RNA, 19 nt, Artificial
  Chemically Synthesized
ucauuuuuuucgcuuugcc

SEQ ID NO: 2341 - RNA, 19 nt, Artificial
  Chemically Synthesized
uuucugaggaaauugcuuu

SEQ ID NO: 2342 - RNA, 19 nt, Artificial
  Chemically Synthesized
cagcacgucaucgacuaca

SEQ ID NO: 2343 - RNA, 19 nt, Artificial
  Chemically Synthesized
uuuuuucgcuuugcccauu

SEQ ID NO: 2344 - RNA, 19 nt, Artificial
  Chemically Synthesized
uucugaggaaauugcuuug

SEQ ID NO: 2345 - RNA, 19 nt, Artificial
  Chemically Synthesized
ucucugcacaccuacuagu

SEQ ID NO: 2346 - RNA, 19 nt, Artificial
  Chemically Synthesized
acucggaauccgaaguugg

SEQ ID NO: 2347 - RNA, 19 nt, Artificial
  Chemically Synthesized
gucaucgacuacaucaggg

SEQ ID NO: 2348 - RNA, 19 nt, Artificial
  Chemically Synthesized
agcagguaaacgugcugcu

SEQ ID NO: 2349 - RNA, 19 nt, Artificial
  Chemically Synthesized
agcagcagguaaacgugcu

SEQ ID NO: 2350 - RNA, 19 nt, Artificial
  Chemically Synthesized
cucugcacaccuacuaguc

SEQ ID NO: 2351 - RNA, 19 nt, Artificial
  Chemically Synthesized
ucugagggagaacaagacc

SEQ ID NO: 2352 - RNA, 19 nt, Artificial
  Chemically Synthesized
uccacguucuuaacuguuc

SEQ ID NO: 2353 - RNA, 19 nt, Artificial
  Chemically Synthesized
uuuucgcuuugcccauucu

SEQ ID NO: 2354 - RNA, 19 nt, Artificial
  Chemically Synthesized
cagauuucugaggaaauug

SEQ ID NO: 2355 - RNA, 19 nt, Artificial
  Chemically Synthesized
uggucacguuuggugcuuc

SEQ ID NO: 2356 - RNA, 19 nt, Artificial
  Chemically Synthesized
uguuacucacgccucaagg

SEQ ID NO: 2357 - RNA, 19 nt, Artificial
  Chemically Synthesized
guaaacgugcugcucuacg

SEQ ID NO: 2358 - RNA, 19 nt, Artificial
  Chemically Synthesized
uacuagucaccagagacuu

SEQ ID NO: 2359 - RNA, 19 nt, Artificial
  Chemically Synthesized
gacuacaucagggaccuuc

SEQ ID NO: 2360 - RNA, 19 nt, Artificial
  Chemically Synthesized
gccaagaaucaugaaaguc

SEQ ID NO: 2361 - RNA, 19 nt, Artificial
  Chemically Synthesized
uauuacaaugaucaccgac

SEQ ID NO: 2362 - RNA, 19 nt, Artificial
  Chemically Synthesized
gcuucucagauuucugagg

SEQ ID NO: 2363 - RNA, 19 nt, Artificial
  Chemically Synthesized
uggagcugaacucggaauc

SEQ ID NO: 2364 - RNA, 19 nt, Artificial
  Chemically Synthesized
cuguuccauuuuccguauc

SEQ ID NO: 2365 - RNA, 19 nt, Artificial
  Chemically Synthesized
uuaacuguuccauuuuccg

SEQ ID NO: 2366 - RNA, 19 nt, Artificial
  Chemically Synthesized
uuccacguucuuaacuguu

SEQ ID NO: 2367 - RNA, 19 nt, Artificial
  Chemically Synthesized
gcuuugcccauucuguuuc

SEQ ID NO: 2368 - RNA, 19 nt, Artificial
  Chemically Synthesized
guauauuacaaugaucacc

SEQ ID NO: 2369 - RNA, 19 nt, Artificial
  Chemically Synthesized
gauuccacucguguguuuc

SEQ ID NO: 2370 - RNA, 19 nt, Artificial
  Chemically Synthesized
aagaggaauuacgugcucu

SEQ ID NO: 2371 - RNA, 19 nt, Artificial
  Chemically Synthesized
gugagcaagguggagauuc

SEQ ID NO: 2372 - RNA, 19 nt, Artificial
  Chemically Synthesized
ugcucuacgacaugaacgg

SEQ ID NO: 2373 - RNA, 19 nt, Artificial
  Chemically Synthesized
aagaaucaugaaagucgcc

SEQ ID NO: 2374 - RNA, 19 nt, Artificial
  Chemically Synthesized
ugcuucucagauuucugag

SEQ ID NO: 2375 - RNA, 19 nt, Artificial
  Chemically Synthesized
uaucugcuucgggcuucca

SEQ ID NO: 2376 - RNA, 19 nt, Artificial
  Chemically Synthesized
ugcccauucuguuucagcc

SEQ ID NO: 2377 - RNA, 19 nt, Artificial
  Chemically Synthesized
ucugaggaaauugcuuugu

SEQ ID NO: 2378 - RNA, 19 nt, Artificial
  Chemically Synthesized
aaauggucacguuuggugc

SEQ ID NO: 2379 - RNA, 19 nt, Artificial
  Chemically Synthesized
ggcaagaggaauuacgugc

SEQ ID NO: 2380 - RNA, 19 nt, Artificial
  Chemically Synthesized
uuccauuuuccguaucugc

SEQ ID NO: 2381 - RNA, 19 nt, Artificial
  Chemically Synthesized
aucgcaucuugugucgcug

SEQ ID NO: 2382 - RNA, 19 nt, Artificial
  Chemically Synthesized
uacgacaugaacggcuguu

SEQ ID NO: 2383 - RNA, 19 nt, Artificial
  Chemically Synthesized
cucauuuuuuucgcuuugc

SEQ ID NO: 2384 - RNA, 19 nt, Artificial
  Chemically Synthesized
cuuaacugcauccagccug

SEQ ID NO: 2385 - RNA, 19 nt, Artificial
  Chemically Synthesized
ggaauccgaaguuggaacc

SEQ ID NO: 2386 - RNA, 19 nt, Artificial
  Chemically Synthesized
uacaucagggaccuucagu

SEQ ID NO: 2387 - RNA, 19 nt, Artificial
  Chemically Synthesized
uuacucacgccucaaggag

SEQ ID NO: 2388 - RNA, 19 nt, Artificial
  Chemically Synthesized
agucaccagagacuuuagg

SEQ ID NO: 2389 - RNA, 19 nt, Artificial
  Chemically Synthesized
gacgaucgcaucuuguguc

SEQ ID NO: 2390 - RNA, 19 nt, Artificial
  Chemically Synthesized
aacucggaauccgaaguug

SEQ ID NO: 2391 - RNA, 19 nt, Artificial
  Chemically Synthesized
aucagggaccuucaguugg

SEQ ID NO: 2392 - RNA, 19 nt, Artificial
  Chemically Synthesized
cugcucuacgacaugaacg

SEQ ID NO: 2393 - RNA, 19 nt, Artificial
  Chemically Synthesized
uccaccucauuuuuuucgc

SEQ ID NO: 2394 - RNA, 19 nt, Artificial
  Chemically Synthesized
auggucacguuuggugcuu

SEQ ID NO: 2395 - RNA, 19 nt, Artificial
  Chemically Synthesized
ugaacggcuguuacucacg

SEQ ID NO: 2396 - RNA, 19 nt, Artificial
  Chemically Synthesized
uucuguuucagccagucgc

SEQ ID NO: 2397 - RNA, 19 nt, Artificial
  Chemically Synthesized
uuugcccauucuguuucag

SEQ ID NO: 2398 - RNA, 19 nt, Artificial
  Chemically Synthesized
uauauuacaaugaucaccg

SEQ ID NO: 2399 - RNA, 19 nt, Artificial
  Chemically Synthesized
gucacguuuggugcuucuc

SEQ ID NO: 2400 - RNA, 19 nt, Artificial
  Chemically Synthesized
uuucgcuuugcccauucug

SEQ ID NO: 2401 - RNA, 19 nt, Artificial
  Chemically Synthesized
gaauccgaaguuggaaccc

SEQ ID NO: 2402 - RNA, 19 nt, Artificial
  Chemically Synthesized
uuuacaauaguucuguggg

SEQ ID NO: 2403 - RNA, 19 nt, Artificial
  Chemically Synthesized
uucaguuggagcugaacuc

SEQ ID NO: 2404 - RNA, 19 nt, Artificial
  Chemically Synthesized
uuggugcuucucagauuuc

SEQ ID NO: 2405 - RNA, 19 nt, Artificial
  Chemically Synthesized
agcaagguggagauucucc

SEQ ID NO: 2406 - RNA, 19 nt, Artificial
  Chemically Synthesized
auuacgugcucuguggguc

SEQ ID NO: 2407 - RNA, 19 nt, Artificial
  Chemically Synthesized
acgaucgcaucuugugucg

SEQ ID NO: 2408 - RNA, 19 nt, Artificial
  Chemically Synthesized
aagguggagauucuccagc

SEQ ID NO: 2409 - RNA, 19 nt, Artificial
  Chemically Synthesized
aaaauggucacguuuggug

SEQ ID NO: 2410 - RNA, 19 nt, Artificial
  Chemically Synthesized
ugcacaccuacuagucacc

SEQ ID NO: 2411 - RNA, 19 nt, Artificial
  Chemically Synthesized
ucaguuggagcugaacucg

SEQ ID NO: 2412 - RNA, 19 nt, Artificial
  Chemically Synthesized
uuuuacaauaguucugugg

SEQ ID NO: 2413 - RNA, 19 nt, Artificial
  Chemically Synthesized
aucuugugucgcugaagcg

SEQ ID NO: 2414 - RNA, 19 nt, Artificial
  Chemically Synthesized
auucuguuucagccagucg

SEQ ID NO: 2415 - RNA, 19 nt, Artificial
  Chemically Synthesized
aucaugaaagucgccagug

SEQ ID NO: 2416 - RNA, 19 nt, Artificial
  Chemically Synthesized
uuuuucgcuuugcccauuc

SEQ ID NO: 2417 - RNA, 19 nt, Artificial
  Chemically Synthesized
auuuuccguaucugcuucg

SEQ ID NO: 2418 - RNA, 19 nt, Artificial
  Chemically Synthesized
aucgacuacaucagggacc

SEQ ID NO: 2419 - RNA, 19 nt, Artificial
  Chemically Synthesized
uuuccguaucugcuucggg

SEQ ID NO: 2420 - RNA, 19 nt, Artificial
  Chemically Synthesized
uugcccauucuguuucagc

SEQ ID NO: 2421 - RNA, 19 nt, Artificial
  Chemically Synthesized
auucuccagcacgucaucg

SEQ ID NO: 2422 - RNA, 19 nt, Artificial
  Chemically Synthesized
uuuuccguaucugcuucgg

SEQ ID NO: 2423 - RNA, 19 nt, Artificial
  Chemically Synthesized
uuccaccucauuuuuuucg

SEQ ID NO: 2424 - RNA, 19 nt, Artificial
  Chemically Synthesized
uuucagucggugaucauug

SEQ ID NO: 2425 - RNA, 19 nt, Artificial
  Chemically Synthesized
uuguucucccucagauccg

SEQ ID NO: 2426 - RNA, 19 nt, Artificial
  Chemically Synthesized
uagagcagcacguuuaccu

SEQ ID NO: 2427 - RNA, 19 nt, Artificial
  Chemically Synthesized
uuuaccugcugcucgucca

SEQ ID NO: 2428 - RNA, 19 nt, Artificial
  Chemically Synthesized
uucggauuccgaguucagc

SEQ ID NO: 2429 - RNA, 19 nt, Artificial
  Chemically Synthesized
uuccgaguucagcuccaac

SEQ ID NO: 2430 - RNA, 19 nt, Artificial
  Chemically Synthesized
aauggaacaguuaagaacg

SEQ ID NO: 2431 - RNA, 19 nt, Artificial
  Chemically Synthesized
uccgaguucagcuccaacu

SEQ ID NO: 2432 - RNA, 19 nt, Artificial
  Chemically Synthesized
uuuucagucggugaucauu

SEQ ID NO: 2433 - RNA, 19 nt, Artificial
  Chemically Synthesized
aucggucuuguucucccuc

SEQ ID NO: 2434 - RNA, 19 nt, Artificial
  Chemically Synthesized
ucuuguucucccucagauc

SEQ ID NO: 2435 - RNA, 19 nt, Artificial
  Chemically Synthesized
ucaugauucuuggcgacug

SEQ ID NO: 2436 - RNA, 19 nt, Artificial
  Chemically Synthesized
uucaugauucuuggcgacu

SEQ ID NO: 2437 - RNA, 19 nt, Artificial
  Chemically Synthesized
cuuguucucccucagaucc

SEQ ID NO: 2438 - RNA, 19 nt, Artificial
  Chemically Synthesized
ugaaggucccugauguagu

SEQ ID NO: 2439 - RNA, 19 nt, Artificial
  Chemically Synthesized
uucaugucguagagcagca

SEQ ID NO: 2440 - RNA, 19 nt, Artificial
  Chemically Synthesized
ucggucuuguucucccuca

SEQ ID NO: 2441 - RNA, 19 nt, Artificial
  Chemically Synthesized
aaaaaaaugagguggaagc

SEQ ID NO: 2442 - RNA, 19 nt, Artificial
  Chemically Synthesized
uucagcgacacaagaugcg

SEQ ID NO: 2443 - RNA, 19 nt, Artificial
  Chemically Synthesized
ucggauuccgaguucagcu

SEQ ID NO: 2444 - RNA, 19 nt, Artificial
  Chemically Synthesized
aauaacaaaaaaacagccc

SEQ ID NO: 2445 - RNA, 19 nt, Artificial
  Chemically Synthesized
ugcuggagaaucuccaccu

SEQ ID NO: 2446 - RNA, 19 nt, Artificial
  Chemically Synthesized
uggagaaucuccaccuugc

SEQ ID NO: 2447 - RNA, 19 nt, Artificial
  Chemically Synthesized
aucuccaccuugcucaccu

SEQ ID NO: 2448 - RNA, 19 nt, Artificial
  Chemically Synthesized
augauucuuggcgacuggc

SEQ ID NO: 2449 - RNA, 19 nt, Artificial
  Chemically Synthesized
ucugagaagcaccaaacgu

SEQ ID NO: 2450 - RNA, 19 nt, Artificial
  Chemically Synthesized
cugagaagcaccaaacgug

SEQ ID NO: 2451 - RNA, 19 nt, Artificial
  Chemically Synthesized
uccaacuucggauuccgag

SEQ ID NO: 2452 - RNA, 19 nt, Artificial
  Chemically Synthesized
ucggugaucauuguaauau

SEQ ID NO: 2453 - RNA, 19 nt, Artificial
  Chemically Synthesized
aagcagauacggaaaaugg

SEQ ID NO: 2454 - RNA, 19 nt, Artificial
  Chemically Synthesized
ugaaacagaaugggcaaag

SEQ ID NO: 2455 - RNA, 19 nt, Artificial
  Chemically Synthesized
aucugagaagcaccaaacg

SEQ ID NO: 2456 - RNA, 19 nt, Artificial
  Chemically Synthesized
ugacgugcuggagaaucuc

SEQ ID NO: 2457 - RNA, 19 nt, Artificial
  Chemically Synthesized
uuucaugauucuuggcgac

SEQ ID NO: 2458 - RNA, 19 nt, Artificial
  Chemically Synthesized
auauuuucagucggugauc

SEQ ID NO: 2459 - RNA, 19 nt, Artificial
  Chemically Synthesized
uaguaggugugcagagagg

SEQ ID NO: 2460 - RNA, 19 nt, Artificial
  Chemically Synthesized
gcgacuuucaugauucuug

SEQ ID NO: 2461 - RNA, 19 nt, Artificial
  Chemically Synthesized
aaacagaaugggcaaagcg

SEQ ID NO: 2462 - RNA, 19 nt, Artificial
  Chemically Synthesized
uuccucagaaaucugagaa

SEQ ID NO: 2463 - RNA, 19 nt, Artificial
  Chemically Synthesized
uucagcuccaacugaaggu

SEQ ID NO: 2464 - RNA, 19 nt, Artificial
  Chemically Synthesized
uugaggcgugaguaacagc

SEQ ID NO: 2465 - RNA, 19 nt, Artificial
  Chemically Synthesized
uauuuucagucggugauca

SEQ ID NO: 2466 - RNA, 19 nt, Artificial
  Chemically Synthesized
ucuggugacuaguaggugu

SEQ ID NO: 2467 - RNA, 19 nt, Artificial
  Chemically Synthesized
cuggcgacuuucaugauuc

SEQ ID NO: 2468 - RNA, 19 nt, Artificial
  Chemically Synthesized
aaaaugagguggaagcccg

SEQ ID NO: 2469 - RNA, 19 nt, Artificial
  Chemically Synthesized
uugcucaccuugcgguucu

SEQ ID NO: 2470 - RNA, 19 nt, Artificial
  Chemically Synthesized
ccacagagcacguaauucc

SEQ ID NO: 2471 - RNA, 19 nt, Artificial
  Chemically Synthesized
uccuugaggcgugaguaac

SEQ ID NO: 2472 - RNA, 19 nt, Artificial
  Chemically Synthesized
aaauggaacaguuaagaac

SEQ ID NO: 2473 - RNA, 19 nt, Artificial
  Chemically Synthesized
augacgugcuggagaaucu

SEQ ID NO: 2474 - RNA, 19 nt, Artificial
  Chemically Synthesized
uaacagccguucaugucgu

SEQ ID NO: 2475 - RNA, 19 nt, Artificial
  Chemically Synthesized
aaacaauauuuucagucgg

SEQ ID NO: 2476 - RNA, 19 nt, Artificial
  Chemically Synthesized
acaauauuuucagucggug

SEQ ID NO: 2477 - RNA, 19 nt, Artificial
  Chemically Synthesized
uucagucggugaucauugu

SEQ ID NO: 2478 - RNA, 19 nt, Artificial
  Chemically Synthesized
auuuccucagaaaucugag

SEQ ID NO: 2479 - RNA, 19 nt, Artificial
  Chemically Synthesized
uacggaaaauggaacaguu

SEQ ID NO: 2480 - RNA, 19 nt, Artificial
  Chemically Synthesized
aacagaaugggcaaagcga

SEQ ID NO: 2481 - RNA, 19 nt, Artificial
  Chemically Synthesized
cacguaauuccucuugccc

SEQ ID NO: 2482 - RNA, 19 nt, Artificial
  Chemically Synthesized
cuucagcgacacaagaugc

SEQ ID NO: 2483 - RNA, 19 nt, Artificial
  Chemically Synthesized
aaggucccugauguagucg

SEQ ID NO: 2484 - RNA, 19 nt, Artificial
  Chemically Synthesized
ucccugauguagucgauga

SEQ ID NO: 2485 - RNA, 19 nt, Artificial
  Chemically Synthesized
aaucuccaccuugcucacc

SEQ ID NO: 2486 - RNA, 19 nt, Artificial
  Chemically Synthesized
acagccguucaugucguag

SEQ ID NO: 2487 - RNA, 19 nt, Artificial
  Chemically Synthesized
aaaaauagaaacacacgag

SEQ ID NO: 2488 - RNA, 19 nt, Artificial
  Chemically Synthesized
ucguagagcagcacguuua

SEQ ID NO: 2489 - RNA, 19 nt, Artificial
  Chemically Synthesized
agcgaaaaaaaugaggugg

SEQ ID NO: 2490 - RNA, 19 nt, Artificial
  Chemically Synthesized
acagagcacguaauuccuc

SEQ ID NO: 2491 - RNA, 19 nt, Artificial
  Chemically Synthesized
uuccaacuucggauuccga

SEQ ID NO: 2492 - RNA, 19 nt, Artificial
  Chemically Synthesized
cugaaggucccugauguag

SEQ ID NO: 2493 - RNA, 19 nt, Artificial
  Chemically Synthesized
uuggcgacuggcugaaaca

SEQ ID NO: 2494 - RNA, 19 nt, Artificial
  Chemically Synthesized
uggaacaguuaagaacgug

SEQ ID NO: 2495 - RNA, 19 nt, Artificial
  Chemically Synthesized
aaaaaugagguggaagccc

SEQ ID NO: 2496 - RNA, 19 nt, Artificial
  Chemically Synthesized
auacggaaaauggaacagu

SEQ ID NO: 2497 - RNA, 19 nt, Artificial
  Chemically Synthesized
acgugcuggagaaucucca

SEQ ID NO: 2498 - RNA, 19 nt, Artificial
  Chemically Synthesized
ugauucuuggcgacuggcu

SEQ ID NO: 2499 - RNA, 19 nt, Artificial
  Chemically Synthesized
uaaagucucuggugacuag

SEQ ID NO: 2500 - RNA, 19 nt, Artificial
  Chemically Synthesized
ucagucggugaucauugua

SEQ ID NO: 2501 - RNA, 19 nt, Artificial
  Chemically Synthesized
aaaauagaaacacacgagu

SEQ ID NO: 2502 - RNA, 19 nt, Artificial
  Chemically Synthesized
augucguagagcagcacgu

SEQ ID NO: 2503 - RNA, 19 nt, Artificial
  Chemically Synthesized
acuggcugaaacagaaugg

SEQ ID NO: 2504 - RNA, 19 nt, Artificial
  Chemically Synthesized
ggaacaguuaagaacgugg

SEQ ID NO: 2505 - RNA, 19 nt, Artificial
  Chemically Synthesized
aauauuuucagucggugau

SEQ ID NO: 2506 - RNA, 19 nt, Artificial
  Chemically Synthesized
ucucuggugacuaguaggu

SEQ ID NO: 2507 - RNA, 19 nt, Artificial
  Chemically Synthesized
cuaguaggugugcagagag

SEQ ID NO: 2508 - RNA, 19 nt, Artificial
  Chemically Synthesized
guuccaacuucggauuccg

SEQ ID NO: 2509 - RNA, 19 nt, Artificial
  Chemically Synthesized
gaugacgugcuggagaauc

SEQ ID NO: 2510 - RNA, 19 nt, Artificial
  Chemically Synthesized
cuggagaaucuccaccuug

SEQ ID NO: 2511 - RNA, 19 nt, Artificial
  Chemically Synthesized
guucaugucguagagcagc

SEQ ID NO: 2512 - RNA, 19 nt, Artificial
  Chemically Synthesized
auucuuggcgacuggcuga

SEQ ID NO: 2513 - RNA, 19 nt, Artificial
  Chemically Synthesized
ucagaaaucugagaagcac

SEQ ID NO: 2514 - RNA, 19 nt, Artificial
  Chemically Synthesized
aaagucucuggugacuagu

SEQ ID NO: 2515 - RNA, 19 nt, Artificial
  Chemically Synthesized
uggcugaaacagaaugggc

SEQ ID NO: 2516 - RNA, 19 nt, Artificial
  Chemically Synthesized
aaagcgaaaaaaaugaggu

SEQ ID NO: 2517 - RNA, 19 nt, Artificial
  Chemically Synthesized
agaaaucugagaagcacca

SEQ ID NO: 2518 - RNA, 19 nt, Artificial
  Chemically Synthesized
ccacuggcgacuuucauga

SEQ ID NO: 2519 - RNA, 19 nt, Artificial
  Chemically Synthesized
auuuucagucggugaucau

SEQ ID NO: 2520 - RNA, 19 nt, Artificial
  Chemically Synthesized
uuuccucagaaaucugaga

SEQ ID NO: 2521 - RNA, 19 nt, Artificial
  Chemically Synthesized
ugagaagcaccaaacguga

SEQ ID NO: 2522 - RNA, 19 nt, Artificial
  Chemically Synthesized
ccaaacgugaccauuuuuu

SEQ ID NO: 2523 - RNA, 19 nt, Artificial
  Chemically Synthesized
caaaaaauagaaacacacg

SEQ ID NO: 2524 - RNA, 19 nt, Artificial
  Chemically Synthesized
ucagcgacacaagaugcga

SEQ ID NO: 2525 - RNA, 19 nt, Artificial
  Chemically Synthesized
gucccugauguagucgaug

SEQ ID NO: 2526 - RNA, 19 nt, Artificial
  Chemically Synthesized
gagaaucuccaccuugcuc

SEQ ID NO: 2527 - RNA, 19 nt, Artificial
  Chemically Synthesized
cuuucaugauucuuggcga

SEQ ID NO: 2528 - RNA, 19 nt, Artificial
  Chemically Synthesized
caaagcgaaaaaaaugagg

SEQ ID NO: 2529 - RNA, 19 nt, Artificial
  Chemically Synthesized
auagaaacacacgagugga

SEQ ID NO: 2530 - RNA, 19 nt, Artificial
  Chemically Synthesized
aacacacgaguggaauccc

SEQ ID NO: 2531 - RNA, 19 nt, Artificial
  Chemically Synthesized
cuggugacuaguaggugug

SEQ ID NO: 2532 - RNA, 19 nt, Artificial
  Chemically Synthesized
auguagucgaugacgugcu

SEQ ID NO: 2533 - RNA, 19 nt, Artificial
  Chemically Synthesized
cgacuuucaugauucuugg

SEQ ID NO: 2534 - RNA, 19 nt, Artificial
  Chemically Synthesized
augggcaaagcgaaaaaaa

SEQ ID NO: 2535 - RNA, 19 nt, Artificial
  Chemically Synthesized
cacagaacuauuguaaaac

SEQ ID NO: 2536 - RNA, 19 nt, Artificial
  Chemically Synthesized
agcaauuuccucagaaauc

SEQ ID NO: 2537 - RNA, 19 nt, Artificial
  Chemically Synthesized
cagaaaucugagaagcacc

SEQ ID NO: 2538 - RNA, 19 nt, Artificial
  Chemically Synthesized
acaguuaagaacguggaau

SEQ ID NO: 2539 - RNA, 19 nt, Artificial
  Chemically Synthesized
acuggcgacuuucaugauu

SEQ ID NO: 2540 - RNA, 19 nt, Artificial
  Chemically Synthesized
caugauucuuggcgacugg

SEQ ID NO: 2541 - RNA, 19 nt, Artificial
  Chemically Synthesized
ugggcaaagcgaaaaaaau

SEQ ID NO: 2542 - RNA, 19 nt, Artificial
  Chemically Synthesized
uccucagaaaucugagaag

SEQ ID NO: 2543 - RNA, 19 nt, Artificial
  Chemically Synthesized
aguaggugugcagagagga

SEQ ID NO: 2544 - RNA, 19 nt, Artificial
  Chemically Synthesized
gagcacguaauuccucuug

SEQ ID NO: 2545 - RNA, 19 nt, Artificial
  Chemically Synthesized
ucagcuccaacugaagguc

SEQ ID NO: 2546 - RNA, 19 nt, Artificial
  Chemically Synthesized
aacugaaggucccugaugu

SEQ ID NO: 2547 - RNA, 19 nt, Artificial
  Chemically Synthesized
ugauguagucgaugacgug

SEQ ID NO: 2548 - RNA, 19 nt, Artificial
  Chemically Synthesized
aauuuccucagaaaucuga

SEQ ID NO: 2549 - RNA, 19 nt, Artificial
  Chemically Synthesized
augcaguuaagggcgcagu

SEQ ID NO: 2550 - RNA, 19 nt, Artificial
  Chemically Synthesized
uucuuggcgacuggcugaa

SEQ ID NO: 2551 - RNA, 19 nt, Artificial
  Chemically Synthesized
agcacguaauuccucuugc

SEQ ID NO: 2552 - RNA, 19 nt, Artificial
  Chemically Synthesized
aagcgaaaaaaaugaggug

SEQ ID NO: 2553 - RNA, 19 nt, Artificial
  Chemically Synthesized
aacaauauuuucagucggu

SEQ ID NO: 2554 - RNA, 19 nt, Artificial
  Chemically Synthesized
gucuuguucucccucagau

SEQ ID NO: 2555 - RNA, 19 nt, Artificial
  Chemically Synthesized
guucagcuccaacugaagg

SEQ ID NO: 2556 - RNA, 19 nt, Artificial
  Chemically Synthesized
aggucccugauguagucga

SEQ ID NO: 2557 - RNA, 19 nt, Artificial
  Chemically Synthesized
guagagcagcacguuuacc

SEQ ID NO: 2558 - RNA, 19 nt, Artificial
  Chemically Synthesized
cacagagcacguaauuccu

SEQ ID NO: 2559 - RNA, 19 nt, Artificial
  Chemically Synthesized
ucgaugacgugcuggagaa

SEQ ID NO: 2560 - RNA, 19 nt, Artificial
  Chemically Synthesized
ugccacuggcgacuuucau

SEQ ID NO: 2561 - RNA, 19 nt, Artificial
  Chemically Synthesized
acagaaugggcaaagcgaa

SEQ ID NO: 2562 - RNA, 19 nt, Artificial
  Chemically Synthesized
aaaaaaugagguggaagcc

SEQ ID NO: 2563 - RNA, 19 nt, Artificial
  Chemically Synthesized
aaauagaaacacacgagug

SEQ ID NO: 2564 - RNA, 19 nt, Artificial
  Chemically Synthesized
ccugauguagucgaugacg

SEQ ID NO: 2565 - RNA, 19 nt, Artificial
  Chemically Synthesized
agagcagcacguuuaccug

SEQ ID NO: 2566 - RNA, 19 nt, Artificial
  Chemically Synthesized
gucucuggugacuaguagg

SEQ ID NO: 2567 - RNA, 19 nt, Artificial
  Chemically Synthesized
ugacuaguaggugugcaga

SEQ ID NO: 2568 - RNA, 19 nt, Artificial
  Chemically Synthesized
cccacagagcacguaauuc

SEQ ID NO: 2569 - RNA, 19 nt, Artificial
  Chemically Synthesized
acguuuaccugcugcucgu

SEQ ID NO: 2570 - RNA, 19 nt, Artificial
  Chemically Synthesized
caauauuuucagucgguga

SEQ ID NO: 2571 - RNA, 19 nt, Artificial
  Chemically Synthesized
agcgacacaagaugcgauc

SEQ ID NO: 2572 - RNA, 19 nt, Artificial
  Chemically Synthesized
agcagauacggaaaaugga

SEQ ID NO: 2573 - RNA, 19 nt, Artificial
  Chemically Synthesized
cagauacggaaaauggaac

SEQ ID NO: 2574 - RNA, 19 nt, Artificial
  Chemically Synthesized
agauacggaaaauggaaca

SEQ ID NO: 2575 - RNA, 19 nt, Artificial
  Chemically Synthesized
cagccguucaugucguaga

SEQ ID NO: 2576 - RNA, 19 nt, Artificial
  Chemically Synthesized
accaaacgugaccauuuuu

SEQ ID NO: 2577 - RNA, 19 nt, Artificial
  Chemically Synthesized
agacccacagagcacguaa

SEQ ID NO: 2578 - RNA, 19 nt, Artificial
  Chemically Synthesized
gggcaaagcgaaaaaaaug

SEQ ID NO: 2579 - RNA, 19 nt, Artificial
  Chemically Synthesized
cagucggugaucauuguaa

SEQ ID NO: 2580 - RNA, 19 nt, Artificial
  Chemically Synthesized
agucucuggugacuaguag

SEQ ID NO: 2581 - RNA, 19 nt, Artificial
  Chemically Synthesized
acuucggauuccgaguuca

SEQ ID NO: 2582 - RNA, 19 nt, Artificial
  Chemically Synthesized
gugaguaacagccguucau

SEQ ID NO: 2583 - RNA, 19 nt, Artificial
  Chemically Synthesized
uggcgacuuucaugauucu

SEQ ID NO: 2584 - RNA, 19 nt, Artificial
  Chemically Synthesized
gacuggcugaaacagaaug

SEQ ID NO: 2585 - RNA, 19 nt, Artificial
  Chemically Synthesized
uggugacuaguaggugugc

SEQ ID NO: 2586 - RNA, 19 nt, Artificial
  Chemically Synthesized
gaagcagauacggaaaaug

SEQ ID NO: 2587 - RNA, 19 nt, Artificial
  Chemically Synthesized
cuucggauuccgaguucag

SEQ ID NO: 2588 - RNA, 19 nt, Artificial
  Chemically Synthesized
uagaaacacacgaguggaa

SEQ ID NO: 2589 - RNA, 19 nt, Artificial
  Chemically Synthesized
cuaaagucucuggugacua

SEQ ID NO: 2590 - RNA, 19 nt, Artificial
  Chemically Synthesized
cagagcacguaauuccucu

SEQ ID NO: 2591 - RNA, 19 nt, Artificial
  Chemically Synthesized
cugauguagucgaugacgu

SEQ ID NO: 2592 - RNA, 19 nt, Artificial
  Chemically Synthesized
ugucguagagcagcacguu

SEQ ID NO: 2593 - RNA, 19 nt, Artificial
  Chemically Synthesized
gaaaaaaaugagguggaag

SEQ ID NO: 2594 - RNA, 19 nt, Artificial
  Chemically Synthesized
aaugagguggaagcccgaa

SEQ ID NO: 2595 - RNA, 19 nt, Artificial
  Chemically Synthesized
aggcuggaugcaguuaagg

SEQ ID NO: 2596 - RNA, 19 nt, Artificial
  Chemically Synthesized
auuccgaguucagcuccaa

SEQ ID NO: 2597 - RNA, 19 nt, Artificial
  Chemically Synthesized
ucuccaccuugcucaccuu

SEQ ID NO: 2598 - RNA, 19 nt, Artificial
  Chemically Synthesized
cuugaggcgugaguaacag

SEQ ID NO: 2599 - RNA, 19 nt, Artificial
  Chemically Synthesized
acggaaaauggaacaguua

SEQ ID NO: 2600 - RNA, 19 nt, Artificial
  Chemically Synthesized
agccguucaugucguagag

SEQ ID NO: 2601 - RNA, 19 nt, Artificial
  Chemically Synthesized
auggaacaguuaagaacgu

SEQ ID NO: 2602 - RNA, 19 nt, Artificial
  Chemically Synthesized
aagcaauuuccucagaaau

SEQ ID NO: 2603 - RNA, 19 nt, Artificial
  Chemically Synthesized
agcaccaaacgugaccauu

SEQ ID NO: 2604 - RNA, 19 nt, Artificial
  Chemically Synthesized
cucuggugacuaguaggug

SEQ ID NO: 2605 - RNA, 19 nt, Artificial
  Chemically Synthesized
gugacuaguaggugugcag

SEQ ID NO: 2606 - RNA, 19 nt, Artificial
  Chemically Synthesized
acccacagagcacguaauu

SEQ ID NO: 2607 - RNA, 19 nt, Artificial
  Chemically Synthesized
gaaaauggaacaguuaaga

SEQ ID NO: 2608 - RNA, 19 nt, Artificial
  Chemically Synthesized
agucggugaucauuguaau

SEQ ID NO: 2609 - RNA, 19 nt, Artificial
  Chemically Synthesized
aaaugagguggaagcccga

SEQ ID NO: 2610 - RNA, 19 nt, Artificial
  Chemically Synthesized
caaacgugaccauuuuuua

SEQ ID NO: 2611 - RNA, 19 nt, Artificial
  Chemically Synthesized
acacacgaguggaauccca

SEQ ID NO: 2612 - RNA, 19 nt, Artificial
  Chemically Synthesized
aguucagcuccaacugaag

SEQ ID NO: 2613 - RNA, 19 nt, Artificial
  Chemically Synthesized
gcaauuuccucagaaaucu

SEQ ID NO: 2614 - RNA, 19 nt, Artificial
  Chemically Synthesized
ccaggcuggaugcaguuaa

SEQ ID NO: 2615 - RNA, 19 nt, Artificial
  Chemically Synthesized
gaguaacagccguucaugu

SEQ ID NO: 2616 - RNA, 19 nt, Artificial
  Chemically Synthesized
ggaaaauggaacaguuaag

SEQ ID NO: 2617 - RNA, 19 nt, Artificial
  Chemically Synthesized
ucuuggcgacuggcugaaa

SEQ ID NO: 2618 - RNA, 19 nt, Artificial
  Chemically Synthesized
cuggcugaaacagaauggg

SEQ ID NO: 2619 - RNA, 19 nt, Artificial
  Chemically Synthesized
agaaacacacgaguggaau

SEQ ID NO: 2620 - RNA, 19 nt, Artificial
  Chemically Synthesized
gcuucagcgacacaagaug

SEQ ID NO: 2621 - RNA, 19 nt, Artificial
  Chemically Synthesized
aacuucggauuccgaguuc

SEQ ID NO: 2622 - RNA, 19 nt, Artificial
  Chemically Synthesized
gucguagagcagcacguuu

SEQ ID NO: 2623 - RNA, 19 nt, Artificial
  Chemically Synthesized
ggcaaagcgaaaaaaauga

SEQ ID NO: 2624 - RNA, 19 nt, Artificial
  Chemically Synthesized
aaagcaauuuccucagaaa

SEQ ID NO: 2625 - RNA, 19 nt, Artificial
  Chemically Synthesized
uguagucgaugacgugcug

SEQ ID NO: 2626 - RNA, 19 nt, Artificial
  Chemically Synthesized
aaugggcaaagcgaaaaaa

SEQ ID NO: 2627 - RNA, 19 nt, Artificial
  Chemically Synthesized
caaagcaauuuccucagaa

SEQ ID NO: 2628 - RNA, 19 nt, Artificial
  Chemically Synthesized
acuaguaggugugcagaga

SEQ ID NO: 2629 - RNA, 19 nt, Artificial
  Chemically Synthesized
ccaacuucggauuccgagu

SEQ ID NO: 2630 - RNA, 19 nt, Artificial
  Chemically Synthesized
cccugauguagucgaugac

SEQ ID NO: 2631 - RNA, 19 nt, Artificial
  Chemically Synthesized
agcagcacguuuaccugcu

SEQ ID NO: 2632 - RNA, 19 nt, Artificial
  Chemically Synthesized
agcacguuuaccugcugcu

SEQ ID NO: 2633 - RNA, 19 nt, Artificial
  Chemically Synthesized
gacuaguaggugugcagag

SEQ ID NO: 2634 - RNA, 19 nt, Artificial
  Chemically Synthesized
ggucuuguucucccucaga

SEQ ID NO: 2635 - RNA, 19 nt, Artificial
  Chemically Synthesized
gaacaguuaagaacgugga

SEQ ID NO: 2636 - RNA, 19 nt, Artificial
  Chemically Synthesized
agaaugggcaaagcgaaaa

SEQ ID NO: 2637 - RNA, 19 nt, Artificial
  Chemically Synthesized
caauuuccucagaaaucug

SEQ ID NO: 2638 - RNA, 19 nt, Artificial
  Chemically Synthesized
gaagcaccaaacgugacca

SEQ ID NO: 2639 - RNA, 19 nt, Artificial
  Chemically Synthesized
ccuugaggcgugaguaaca

SEQ ID NO: 2640 - RNA, 19 nt, Artificial
  Chemically Synthesized
cguagagcagcacguuuac

SEQ ID NO: 2641 - RNA, 19 nt, Artificial
  Chemically Synthesized
aagucucuggugacuagua

SEQ ID NO: 2642 - RNA, 19 nt, Artificial
  Chemically Synthesized
gaaggucccugauguaguc

SEQ ID NO: 2643 - RNA, 19 nt, Artificial
  Chemically Synthesized
gacuuucaugauucuuggc

SEQ ID NO: 2644 - RNA, 19 nt, Artificial
  Chemically Synthesized
gucggugaucauuguaaua

SEQ ID NO: 2645 - RNA, 19 nt, Artificial
  Chemically Synthesized
ccucagaaaucugagaagc

SEQ ID NO: 2646 - RNA, 19 nt, Artificial
  Chemically Synthesized
gauuccgaguucagcucca

SEQ ID NO: 2647 - RNA, 19 nt, Artificial
  Chemically Synthesized
gauacggaaaauggaacag

SEQ ID NO: 2648 - RNA, 19 nt, Artificial
  Chemically Synthesized
cggaaaauggaacaguuaa

SEQ ID NO: 2649 - RNA, 19 nt, Artificial
  Chemically Synthesized
aacaguuaagaacguggaa

SEQ ID NO: 2650 - RNA, 19 nt, Artificial
  Chemically Synthesized
gaaacagaaugggcaaagc

SEQ ID NO: 2651 - RNA, 19 nt, Artificial
  Chemically Synthesized
ggugaucauuguaauauac

SEQ ID NO: 2652 - RNA, 19 nt, Artificial
  Chemically Synthesized
gaaacacacgaguggaauc

SEQ ID NO: 2653 - RNA, 19 nt, Artificial
  Chemically Synthesized
agagcacguaauuccucuu

SEQ ID NO: 2654 - RNA, 19 nt, Artificial
  Chemically Synthesized
gaaucuccaccuugcucac

SEQ ID NO: 2655 - RNA, 19 nt, Artificial
  Chemically Synthesized
ccguucaugucguagagca

SEQ ID NO: 2656 - RNA, 19 nt, Artificial
  Chemically Synthesized
ggcgacuuucaugauucuu

SEQ ID NO: 2657 - RNA, 19 nt, Artificial
  Chemically Synthesized
cucagaaaucugagaagca

SEQ ID NO: 2658 - RNA, 19 nt, Artificial
  Chemically Synthesized
uggaagcccgaagcagaua

SEQ ID NO: 2659 - RNA, 19 nt, Artificial
  Chemically Synthesized
ggcugaaacagaaugggca

SEQ ID NO: 2660 - RNA, 19 nt, Artificial
  Chemically Synthesized
acaaagcaauuuccucaga

SEQ ID NO: 2661 - RNA, 19 nt, Artificial
  Chemically Synthesized
gcaccaaacgugaccauuu

SEQ ID NO: 2662 - RNA, 19 nt, Artificial
  Chemically Synthesized
gcacguaauuccucuugcc

SEQ ID NO: 2663 - RNA, 19 nt, Artificial
  Chemically Synthesized
gcagauacggaaaauggaa

SEQ ID NO: 2664 - RNA, 19 nt, Artificial
  Chemically Synthesized
cagcgacacaagaugcgau

SEQ ID NO: 2665 - RNA, 19 nt, Artificial
  Chemically Synthesized
aacagccguucaugucgua

SEQ ID NO: 2666 - RNA, 19 nt, Artificial
  Chemically Synthesized
gcaaagcgaaaaaaaugag

SEQ ID NO: 2667 - RNA, 19 nt, Artificial
  Chemically Synthesized
caggcuggaugcaguuaag

SEQ ID NO: 2668 - RNA, 19 nt, Artificial
  Chemically Synthesized
gguuccaacuucggauucc

SEQ ID NO: 2669 - RNA, 19 nt, Artificial
  Chemically Synthesized
acugaaggucccugaugua

SEQ ID NO: 2670 - RNA, 19 nt, Artificial
  Chemically Synthesized
cuccuugaggcgugaguaa

SEQ ID NO: 2671 - RNA, 19 nt, Artificial
  Chemically Synthesized
ccuaaagucucuggugacu

SEQ ID NO: 2672 - RNA, 19 nt, Artificial
  Chemically Synthesized
gacacaagaugcgaucguc

SEQ ID NO: 2673 - RNA, 19 nt, Artificial
  Chemically Synthesized
caacuucggauuccgaguu

SEQ ID NO: 2674 - RNA, 19 nt, Artificial
  Chemically Synthesized
ccaacugaaggucccugau

SEQ ID NO: 2675 - RNA, 19 nt, Artificial
  Chemically Synthesized
cguucaugucguagagcag

SEQ ID NO: 2676 - RNA, 19 nt, Artificial
  Chemically Synthesized
gcgaaaaaaaugaggugga

SEQ ID NO: 2677 - RNA, 19 nt, Artificial
  Chemically Synthesized
aagcaccaaacgugaccau

SEQ ID NO: 2678 - RNA, 19 nt, Artificial
  Chemically Synthesized
cgugaguaacagccguuca

SEQ ID NO: 2679 - RNA, 19 nt, Artificial
  Chemically Synthesized
gcgacuggcugaaacagaa

SEQ ID NO: 2680 - RNA, 19 nt, Artificial
  Chemically Synthesized
cugaaacagaaugggcaaa

SEQ ID NO: 2681 - RNA, 19 nt, Artificial
  Chemically Synthesized
cggugaucauuguaauaua

SEQ ID NO: 2682 - RNA, 19 nt, Artificial
  Chemically Synthesized
gagaagcaccaaacgugac

SEQ ID NO: 2683 - RNA, 19 nt, Artificial
  Chemically Synthesized
cagaaugggcaaagcgaaa

SEQ ID NO: 2684 - RNA, 19 nt, Artificial
  Chemically Synthesized
ggguuccaacuucggauuc

SEQ ID NO: 2685 - RNA, 19 nt, Artificial
  Chemically Synthesized
cccacagaacuauuguaaa

SEQ ID NO: 2686 - RNA, 19 nt, Artificial
  Chemically Synthesized
gaguucagcuccaacugaa

SEQ ID NO: 2687 - RNA, 19 nt, Artificial
  Chemically Synthesized
gaaaucugagaagcaccaa

SEQ ID NO: 2688 - RNA, 19 nt, Artificial
  Chemically Synthesized
ggagaaucuccaccuugcu

SEQ ID NO: 2689 - RNA, 19 nt, Artificial
  Chemically Synthesized
gacccacagagcacguaau

SEQ ID NO: 2690 - RNA, 19 nt, Artificial
  Chemically Synthesized
cgacacaagaugcgaucgu

SEQ ID NO: 2691 - RNA, 19 nt, Artificial
  Chemically Synthesized
gcuggagaaucuccaccuu

SEQ ID NO: 2692 - RNA, 19 nt, Artificial
  Chemically Synthesized
caccaaacgugaccauuuu

SEQ ID NO: 2693 - RNA, 19 nt, Artificial
  Chemically Synthesized
ggugacuaguaggugugca

SEQ ID NO: 2694 - RNA, 19 nt, Artificial
  Chemically Synthesized
cgaguucagcuccaacuga

SEQ ID NO: 2695 - RNA, 19 nt, Artificial
  Chemically Synthesized
ccacagaacuauuguaaaa

SEQ ID NO: 2696 - RNA, 19 nt, Artificial
  Chemically Synthesized
cgcuucagcgacacaagau

SEQ ID NO: 2697 - RNA, 19 nt, Artificial
  Chemically Synthesized
cgacuggcugaaacagaau

SEQ ID NO: 2698 - RNA, 19 nt, Artificial
  Chemically Synthesized
cacuggcgacuuucaugau

SEQ ID NO: 2699 - RNA, 19 nt, Artificial
  Chemically Synthesized
gaaugggcaaagcgaaaaa

SEQ ID NO: 2700 - RNA, 19 nt, Artificial
  Chemically Synthesized
cgaagcagauacggaaaau

SEQ ID NO: 2701 - RNA, 19 nt, Artificial
  Chemically Synthesized
ggucccugauguagucgau

SEQ ID NO: 2702 - RNA, 19 nt, Artificial
  Chemically Synthesized
cccgaagcagauacggaaa

SEQ ID NO: 2703 - RNA, 19 nt, Artificial
  Chemically Synthesized
gcugaaacagaaugggcaa

SEQ ID NO: 2704 - RNA, 19 nt, Artificial
  Chemically Synthesized
cgaugacgugcuggagaau

SEQ ID NO: 2705 - RNA, 19 nt, Artificial
  Chemically Synthesized
ccgaagcagauacggaaaa

SEQ ID NO: 2706 - RNA, 19 nt, Artificial
  Chemically Synthesized
cgaaaaaaaugagguggaa

SEQ ID NO: 2707 - RNA, 19 nt, artificial
  Chemically Synthesized
ugcuauacaacaugaacga

SEQ ID NO: 2708 - RNA, 19 nt, artificial
  Chemically Synthesized
augaacgacugcuacucca

SEQ ID NO: 2709 - RNA, 19 nt, artificial
  Chemically Synthesized
acaacaugaacgacugcua

SEQ ID NO: 2710 - RNA, 19 nt, artificial
  Chemically Synthesized
uguuauaacugaacccaaa

SEQ ID NO: 2711 - RNA, 19 nt, artificial
  Chemically Synthesized
gccugcuauacaacaugaa

SEQ ID NO: 2712 - RNA, 19 nt, artificial
  Chemically Synthesized
ccuucugaguuaaugucaa

SEQ ID NO: 2713 - RNA, 19 nt, artificial
  Chemically Synthesized
gucuauuucugcauucaaa

SEQ ID NO: 2714 - RNA, 19 nt, artificial
  Chemically Synthesized
cgaaaacguuaaaaucaca

SEQ ID NO: 2715 - RNA, 19 nt, artificial
  Chemically Synthesized
ugaacgacugcuacuccaa

SEQ ID NO: 2716 - RNA, 19 nt, artificial
  Chemically Synthesized
caacaugaacgacugcuac

SEQ ID NO: 2717 - RNA, 19 nt, artificial
  Chemically Synthesized
cuauacaacaugaacgacu

SEQ ID NO: 2718 - RNA, 19 nt, artificial
  Chemically Synthesized
uauacaacaugaacgacug

SEQ ID NO: 2719 - RNA, 19 nt, artificial
  Chemically Synthesized
cguuaaaaucacaaggaau

SEQ ID NO: 2720 - RNA, 19 nt, artificial
  Chemically Synthesized
gaaggaaaacuaagaauga

SEQ ID NO: 2721 - RNA, 19 nt, artificial
  Chemically Synthesized
gaaucuuuuaagugcugaa

SEQ ID NO: 2722 - RNA, 19 nt, artificial
  Chemically Synthesized
gacuuugccuuuuuucaaa

SEQ ID NO: 2723 - RNA, 19 nt, artificial
  Chemically Synthesized
cggucagcaugaaagccuu

SEQ ID NO: 2724 - RNA, 19 nt, artificial
  Chemically Synthesized
acguuaaaaucacaaggaa

SEQ ID NO: 2725 - RNA, 19 nt, artificial
  Chemically Synthesized
ggguguucucuuacuugga

SEQ ID NO: 2726 - RNA, 19 nt, artificial
  Chemically Synthesized
ccuacugaaugcuguguau

SEQ ID NO: 2727 - RNA, 19 nt, artificial
  Chemically Synthesized
gaagucuuuuggucagaaa

SEQ ID NO: 2728 - RNA, 19 nt, artificial
  Chemically Synthesized
ccaguauucagucacuuaa

SEQ ID NO: 2729 - RNA, 19 nt, artificial
  Chemically Synthesized
caguauucagucacuuaaa

SEQ ID NO: 2730 - RNA, 19 nt, artificial
  Chemically Synthesized
caaggaauugcccaaucua

SEQ ID NO: 2731 - RNA, 19 nt, artificial
  Chemically Synthesized
gaacgacugcuacuccaag

SEQ ID NO: 2732 - RNA, 19 nt, artificial
  Chemically Synthesized
ggagcgaaaacguuaaaau

SEQ ID NO: 2733 - RNA, 19 nt, artificial
  Chemically Synthesized
gaacccaaauaaauacaag

SEQ ID NO: 2734 - RNA, 19 nt, artificial
  Chemically Synthesized
gcuauacaacaugaacgac

SEQ ID NO: 2735 - RNA, 19 nt, artificial
  Chemically Synthesized
aaggaauugcccaaucuaa

SEQ ID NO: 2736 - RNA, 19 nt, artificial
  Chemically Synthesized
agaaggugagcaagaugga

SEQ ID NO: 2737 - RNA, 19 nt, artificial
  Chemically Synthesized
acugcuacuccaagcucaa

SEQ ID NO: 2738 - RNA, 19 nt, artificial
  Chemically Synthesized
gggagcgaaaacguuaaaa

SEQ ID NO: 2739 - RNA, 19 nt, artificial
  Chemically Synthesized
ggacugugauauucguuau

SEQ ID NO: 2740 - RNA, 19 nt, artificial
  Chemically Synthesized
ccagugcuuugauuuuuau

SEQ ID NO: 2741 - RNA, 19 nt, artificial
  Chemically Synthesized
caugaacgacugcuacucc

SEQ ID NO: 2742 - RNA, 19 nt, artificial
  Chemically Synthesized
ccuuuuugacacaagccua

SEQ ID NO: 2743 - RNA, 19 nt, artificial
  Chemically Synthesized
guccuugcaggcuucugaa

SEQ ID NO: 2744 - RNA, 19 nt, artificial
  Chemically Synthesized
ugagguccguuaggaaaaa

SEQ ID NO: 2745 - RNA, 19 nt, artificial
  Chemically Synthesized
ggaaaacuaagaaugauca

SEQ ID NO: 2746 - RNA, 19 nt, artificial
  Chemically Synthesized
gugagguccguuaggaaaa

SEQ ID NO: 2747 - RNA, 19 nt, artificial
  Chemically Synthesized
guuggaagguuuucuuuau

SEQ ID NO: 2748 - RNA, 19 nt, artificial
  Chemically Synthesized
cauuucacaaggaggacaa

SEQ ID NO: 2749 - RNA, 19 nt, artificial
  Chemically Synthesized
ggaaaaacagccugucgga

SEQ ID NO: 2750 - RNA, 19 nt, artificial
  Chemically Synthesized
aggugagcaagauggaaau

SEQ ID NO: 2751 - RNA, 19 nt, artificial
  Chemically Synthesized
ggugauugccugcuuuauu

SEQ ID NO: 2752 - RNA, 19 nt, artificial
  Chemically Synthesized
ugauguacuuauucaugcu

SEQ ID NO: 2753 - RNA, 19 nt, artificial
  Chemically Synthesized
cuuguauaguggcagagau

SEQ ID NO: 2754 - RNA, 19 nt, artificial
  Chemically Synthesized
ccuugugaacucuuuaauu

SEQ ID NO: 2755 - RNA, 19 nt, artificial
  Chemically Synthesized
agccugcuauacaacauga

SEQ ID NO: 2756 - RNA, 19 nt, artificial
  Chemically Synthesized
gcccuuucugcaguuggaa

SEQ ID NO: 2757 - RNA, 19 nt, artificial
  Chemically Synthesized
caacaacaaauucacggaa

SEQ ID NO: 2758 - RNA, 19 nt, artificial
  Chemically Synthesized
cugaauaagcgguguucau

SEQ ID NO: 2759 - RNA, 19 nt, artificial
  Chemically Synthesized
gaguuaaugucaaaugaca

SEQ ID NO: 2760 - RNA, 19 nt, artificial
  Chemically Synthesized
auguuauaacugaacccaa

SEQ ID NO: 2761 - RNA, 19 nt, artificial
  Chemically Synthesized
ugucuauuucugcauucaa

SEQ ID NO: 2762 - RNA, 19 nt, artificial
  Chemically Synthesized
gcgugaauaccagaaggau

SEQ ID NO: 2763 - RNA, 19 nt, artificial
  Chemically Synthesized
caaagguggagcgugaaua

SEQ ID NO: 2764 - RNA, 19 nt, artificial
  Chemically Synthesized
ccugcuauacaacaugaac

SEQ ID NO: 2765 - RNA, 19 nt, artificial
  Chemically Synthesized
gauguacuuauucaugcua

SEQ ID NO: 2766 - RNA, 19 nt, artificial
  Chemically Synthesized
gaaggauccaguauucagu

SEQ ID NO: 2767 - RNA, 19 nt, artificial
  Chemically Synthesized
accagugcuuugauuuuua

SEQ ID NO: 2768 - RNA, 19 nt, artificial
  Chemically Synthesized
ggaccagugcuuugauuuu

SEQ ID NO: 2769 - RNA, 19 nt, artificial
  Chemically Synthesized
uguguuuauugaaugguga

SEQ ID NO: 2770 - RNA, 19 nt, artificial
  Chemically Synthesized
gacugcuacuccaagcuca

SEQ ID NO: 2771 - RNA, 19 nt, artificial
  Chemically Synthesized
ucugcauucaaaaguguaa

SEQ ID NO: 2772 - RNA, 19 nt, artificial
  Chemically Synthesized
cuuugcacaacaacaacaa

SEQ ID NO: 2773 - RNA, 19 nt, artificial
  Chemically Synthesized
aaugucaaaugacagcaaa

SEQ ID NO: 2774 - RNA, 19 nt, artificial
  Chemically Synthesized
gcuuuauuucagaggacca

SEQ ID NO: 2775 - RNA, 19 nt, artificial
  Chemically Synthesized
acugaaugcuguguauaua

SEQ ID NO: 2776 - RNA, 19 nt, artificial
  Chemically Synthesized
acccgaugagccugcuaua

SEQ ID NO: 2777 - RNA, 19 nt, artificial
  Chemically Synthesized
agaggaccagugcuuugau

SEQ ID NO: 2778 - RNA, 19 nt, artificial
  Chemically Synthesized
aaaccuugugaacucuuua

SEQ ID NO: 2779 - RNA, 19 nt, artificial
  Chemically Synthesized
aacaugaacgacugcuacu

SEQ ID NO: 2780 - RNA, 19 nt, artificial
  Chemically Synthesized
aguuggaagguuuucuuua

SEQ ID NO: 2781 - RNA, 19 nt, artificial
  Chemically Synthesized
cuuggacugugauauucgu

SEQ ID NO: 2782 - RNA, 19 nt, artificial
  Chemically Synthesized
ccaggguguucucuuacuu

SEQ ID NO: 2783 - RNA, 19 nt, artificial
  Chemically Synthesized
cacaaggaggacaaguuga

SEQ ID NO: 2784 - RNA, 19 nt, artificial
  Chemically Synthesized
acaugaacgacugcuacuc

SEQ ID NO: 2785 - RNA, 19 nt, artificial
  Chemically Synthesized
gcaagauggaaauccugca

SEQ ID NO: 2786 - RNA, 19 nt, artificial
  Chemically Synthesized
gaaaccuugugaacucuuu

SEQ ID NO: 2787 - RNA, 19 nt, artificial
  Chemically Synthesized
gcaguuggaagguuuucuu

SEQ ID NO: 2788 - RNA, 19 nt, artificial
  Chemically Synthesized
cuauugucagccugcauca

SEQ ID NO: 2789 - RNA, 19 nt, artificial
  Chemically Synthesized
ccacuauugucagccugca

SEQ ID NO: 2790 - RNA, 19 nt, artificial
  Chemically Synthesized
agagaugucuauuucugca

SEQ ID NO: 2791 - RNA, 19 nt, artificial
  Chemically Synthesized
cugaaugcuguguauauau

SEQ ID NO: 2792 - RNA, 19 nt, artificial
  Chemically Synthesized
uugacacaagccuacugaa

SEQ ID NO: 2793 - RNA, 19 nt, artificial
  Chemically Synthesized
ugcacaacaacaacaacaa

SEQ ID NO: 2794 - RNA, 19 nt, artificial
  Chemically Synthesized
guuauaacugaacccaaau

SEQ ID NO: 2795 - RNA, 19 nt, artificial
  Chemically Synthesized
uugagugaaaccuugugaa

SEQ ID NO: 2796 - RNA, 19 nt, artificial
  Chemically Synthesized
uuucaaagguggagcguga

SEQ ID NO: 2797 - RNA, 19 nt, artificial
  Chemically Synthesized
gaaugaucaucuucccagg

SEQ ID NO: 2798 - RNA, 19 nt, artificial
  Chemically Synthesized
aaagcacuguguggcugaa

SEQ ID NO: 2799 - RNA, 19 nt, artificial
  Chemically Synthesized
uugucagccugcaucacca

SEQ ID NO: 2800 - RNA, 19 nt, artificial
  Chemically Synthesized
agauggaaauccugcagca

SEQ ID NO: 2801 - RNA, 19 nt, artificial
  Chemically Synthesized
gaggaccagugcuuugauu

SEQ ID NO: 2802 - RNA, 19 nt, artificial
  Chemically Synthesized
gauccaguauucagucacu

SEQ ID NO: 2803 - RNA, 19 nt, artificial
  Chemically Synthesized
gguccguuaggaaaaacag

SEQ ID NO: 2804 - RNA, 19 nt, artificial
  Chemically Synthesized
gugauugccugcuuuauuu

SEQ ID NO: 2805 - RNA, 19 nt, artificial
  Chemically Synthesized
gaauggugauugccugcuu

SEQ ID NO: 2806 - RNA, 19 nt, artificial
  Chemically Synthesized
guguuuauugaauggugau

SEQ ID NO: 2807 - RNA, 19 nt, artificial
  Chemically Synthesized
agacuuugccuuuuuucaa

SEQ ID NO: 2808 - RNA, 19 nt, artificial
  Chemically Synthesized
ucucuuacuuggacuguga

SEQ ID NO: 2809 - RNA, 19 nt, artificial
  Chemically Synthesized
ggcagagaugucuauuucu

SEQ ID NO: 2810 - RNA, 19 nt, artificial
  Chemically Synthesized
caaagcacuguguggcuga

SEQ ID NO: 2811 - RNA, 19 nt, artificial
  Chemically Synthesized
caagccuacugaaugcugu

SEQ ID NO: 2812 - RNA, 19 nt, artificial
  Chemically Synthesized
uggagcgugaauaccagaa

SEQ ID NO: 2813 - RNA, 19 nt, artificial
  Chemically Synthesized
uucccaggguguucucuua

SEQ ID NO: 2814 - RNA, 19 nt, artificial
  Chemically Synthesized
uaaugucaaaugacagcaa

SEQ ID NO: 2815 - RNA, 19 nt, artificial
  Chemically Synthesized
cagaggaccagugcuuuga

SEQ ID NO: 2816 - RNA, 19 nt, artificial
  Chemically Synthesized
ggagcgugaauaccagaag

SEQ ID NO: 2817 - RNA, 19 nt, artificial
  Chemically Synthesized
agcgaaaacguuaaaauca

SEQ ID NO: 2818 - RNA, 19 nt, artificial
  Chemically Synthesized
gagcgaaaacguuaaaauc

SEQ ID NO: 2819 - RNA, 19 nt, artificial
  Chemically Synthesized
caguuggaagguuuucuuu

SEQ ID NO: 2820 - RNA, 19 nt, artificial
  Chemically Synthesized
uggacugugauauucguua

SEQ ID NO: 2821 - RNA, 19 nt, artificial
  Chemically Synthesized
cccaggguguucucuuacu

SEQ ID NO: 2822 - RNA, 19 nt, artificial
  Chemically Synthesized
ggaaucuuuuaagugcuga

SEQ ID NO: 2823 - RNA, 19 nt, artificial
  Chemically Synthesized
caaaugacagcaaagcacu

SEQ ID NO: 2824 - RNA, 19 nt, artificial
  Chemically Synthesized
gauugccugcuuuauuuca

SEQ ID NO: 2825 - RNA, 19 nt, artificial
  Chemically Synthesized
guuguaaacuuaacccuuu

SEQ ID NO: 2826 - RNA, 19 nt, artificial
  Chemically Synthesized
aaccuugugaacucuuuaa

SEQ ID NO: 2827 - RNA, 19 nt, artificial
  Chemically Synthesized
uacugaaugcuguguauau

SEQ ID NO: 2828 - RNA, 19 nt, artificial
  Chemically Synthesized
aagucuuuuggucagaaau

SEQ ID NO: 2829 - RNA, 19 nt, artificial
  Chemically Synthesized
ugcccuuucugcaguugga

SEQ ID NO: 2830 - RNA, 19 nt, artificial
  Chemically Synthesized
uggaaggaaaacuaagaau

SEQ ID NO: 2831 - RNA, 19 nt, artificial
  Chemically Synthesized
aguuguaaacuuaacccuu

SEQ ID NO: 2832 - RNA, 19 nt, artificial
  Chemically Synthesized
gccuacugaaugcugugua

SEQ ID NO: 2833 - RNA, 19 nt, artificial
  Chemically Synthesized
aaaugaagucuuuugguca

SEQ ID NO: 2834 - RNA, 19 nt, artificial
  Chemically Synthesized
cagacuuugccuuuuuuca

SEQ ID NO: 2835 - RNA, 19 nt, artificial
  Chemically Synthesized
acaaauucacggaaucuuu

SEQ ID NO: 2836 - RNA, 19 nt, artificial
  Chemically Synthesized
gguguucaugauuucuuuu

SEQ ID NO: 2837 - RNA, 19 nt, artificial
  Chemically Synthesized
agguccguuaggaaaaaca

SEQ ID NO: 2838 - RNA, 19 nt, artificial
  Chemically Synthesized
acuacaucuuggaccugca

SEQ ID NO: 2839 - RNA, 19 nt, artificial
  Chemically Synthesized
ccugcuuuauuucagagga

SEQ ID NO: 2840 - RNA, 19 nt, artificial
  Chemically Synthesized
agaugucuauuucugcauu

SEQ ID NO: 2841 - RNA, 19 nt, artificial
  Chemically Synthesized
cuauuugagugaaaccuug

SEQ ID NO: 2842 - RNA, 19 nt, artificial
  Chemically Synthesized
guggagcgugaauaccaga

SEQ ID NO: 2843 - RNA, 19 nt, artificial
  Chemically Synthesized
gccuuuuuucaaaggugga

SEQ ID NO: 2844 - RNA, 19 nt, artificial
  Chemically Synthesized
cucuuacuuggacugugau

SEQ ID NO: 2845 - RNA, 19 nt, artificial
  Chemically Synthesized
ucaucgacuacaucuugga

SEQ ID NO: 2846 - RNA, 19 nt, artificial
  Chemically Synthesized
gaacaagaaggugagcaag

SEQ ID NO: 2847 - RNA, 19 nt, artificial
  Chemically Synthesized
cugcauucaaaaguguaau

SEQ ID NO: 2848 - RNA, 19 nt, artificial
  Chemically Synthesized
agguggagcgugaauacca

SEQ ID NO: 2849 - RNA, 19 nt, artificial
  Chemically Synthesized
ucuuacuuggacugugaua

SEQ ID NO: 2850 - RNA, 19 nt, artificial
  Chemically Synthesized
ccauuucacaaggaggaca

SEQ ID NO: 2851 - RNA, 19 nt, artificial
  Chemically Synthesized
cccuucugaguuaauguca

SEQ ID NO: 2852 - RNA, 19 nt, artificial
  Chemically Synthesized
uccaguauucagucacuua

SEQ ID NO: 2853 - RNA, 19 nt, artificial
  Chemically Synthesized
ucugcaguuggaagguuuu

SEQ ID NO: 2854 - RNA, 19 nt, artificial
  Chemically Synthesized
gacugugauauucguuauu

SEQ ID NO: 2855 - RNA, 19 nt, artificial
  Chemically Synthesized
cccucaacacggauaucag

SEQ ID NO: 2856 - RNA, 19 nt, artificial
  Chemically Synthesized
gcuacuccaagcucaagga

SEQ ID NO: 2857 - RNA, 19 nt, artificial
  Chemically Synthesized
gucuuuuggucagaaauua

SEQ ID NO: 2858 - RNA, 19 nt, artificial
  Chemically Synthesized
auaccagaaggauccagua

SEQ ID NO: 2859 - RNA, 19 nt, artificial
  Chemically Synthesized
ucuuuuaagugcugaacuu

SEQ ID NO: 2860 - RNA, 19 nt, artificial
  Chemically Synthesized
acaacaacaaauucacgga

SEQ ID NO: 2861 - RNA, 19 nt, artificial
  Chemically Synthesized
aaauccugcagcacgucau

SEQ ID NO: 2862 - RNA, 19 nt, artificial
  Chemically Synthesized
cccaaauaaauacaaguuc

SEQ ID NO: 2863 - RNA, 19 nt, artificial
  Chemically Synthesized
cuacugaaugcuguguaua

SEQ ID NO: 2864 - RNA, 19 nt, artificial
  Chemically Synthesized
ggucagaaauuaccuuuuu

SEQ ID NO: 2865 - RNA, 19 nt, artificial
  Chemically Synthesized
ugaagucuuuuggucagaa

SEQ ID NO: 2866 - RNA, 19 nt, artificial
  Chemically Synthesized
agaaggauccaguauucag

SEQ ID NO: 2867 - RNA, 19 nt, artificial
  Chemically Synthesized
ucaaagguggagcgugaau

SEQ ID NO: 2868 - RNA, 19 nt, artificial
  Chemically Synthesized
uucaaagguggagcgugaa

SEQ ID NO: 2869 - RNA, 19 nt, artificial
  Chemically Synthesized
ggaaggaaaacuaagaaug

SEQ ID NO: 2870 - RNA, 19 nt, artificial
  Chemically Synthesized
gcugaauaagcgguguuca

SEQ ID NO: 2871 - RNA, 19 nt, artificial
  Chemically Synthesized
cacuguguggcugaauaag

SEQ ID NO: 2872 - RNA, 19 nt, artificial
  Chemically Synthesized
caggcuucugaauucccuu

SEQ ID NO: 2873 - RNA, 19 nt, artificial
  Chemically Synthesized
gaaauccugcagcacguca

SEQ ID NO: 2874 - RNA, 19 nt, artificial
  Chemically Synthesized
aauggugauugccugcuuu

SEQ ID NO: 2875 - RNA, 19 nt, artificial
  Chemically Synthesized
uuucuuguauaguggcaga

SEQ ID NO: 2876 - RNA, 19 nt, artificial
  Chemically Synthesized
cagaaauuaccuuuuugac

SEQ ID NO: 2877 - RNA, 19 nt, artificial
  Chemically Synthesized
gcaggcuucugaauucccu

SEQ ID NO: 2878 - RNA, 19 nt, artificial
  Chemically Synthesized
ucagcauccuguccuugca

SEQ ID NO: 2879 - RNA, 19 nt, artificial
  Chemically Synthesized
cacuauugucagccugcau

SEQ ID NO: 2880 - RNA, 19 nt, artificial
  Chemically Synthesized
ucuuguauaguggcagaga

SEQ ID NO: 2881 - RNA, 19 nt, artificial
  Chemically Synthesized
aaagguggagcgugaauac

SEQ ID NO: 2882 - RNA, 19 nt, artificial
  Chemically Synthesized
aucacaaggaauugcccaa

SEQ ID NO: 2883 - RNA, 19 nt, artificial
  Chemically Synthesized
gcgaaaacguuaaaaucac

SEQ ID NO: 2884 - RNA, 19 nt, artificial
  Chemically Synthesized
caaauucacggaaucuuuu

SEQ ID NO: 2885 - RNA, 19 nt, artificial
  Chemically Synthesized
auaucagcauccuguccuu

SEQ ID NO: 2886 - RNA, 19 nt, artificial
  Chemically Synthesized
ccucaacacggauaucagc

SEQ ID NO: 2887 - RNA, 19 nt, artificial
  Chemically Synthesized
uggaaauccugcagcacgu

SEQ ID NO: 2888 - RNA, 19 nt, artificial
  Chemically Synthesized
guguguuuauugaauggug

SEQ ID NO: 2889 - RNA, 19 nt, artificial
  Chemically Synthesized
gcauucaaaaguguaauga

SEQ ID NO: 2890 - RNA, 19 nt, artificial
  Chemically Synthesized
gagugaaaccuugugaacu

SEQ ID NO: 2891 - RNA, 19 nt, artificial
  Chemically Synthesized
aggaauugcccaaucuaag

SEQ ID NO: 2892 - RNA, 19 nt, artificial
  Chemically Synthesized
aaccauuucacaaggagga

SEQ ID NO: 2893 - RNA, 19 nt, artificial
  Chemically Synthesized
caaccauuucacaaggagg

SEQ ID NO: 2894 - RNA, 19 nt, artificial
  Chemically Synthesized
gcgguguucaugauuucuu

SEQ ID NO: 2895 - RNA, 19 nt, artificial
  Chemically Synthesized
ccuugcaggcuucugaauu

SEQ ID NO: 2896 - RNA, 19 nt, artificial
  Chemically Synthesized
ccacccucaacacggauau

SEQ ID NO: 2897 - RNA, 19 nt, artificial
  Chemically Synthesized
acaucuuggaccugcagau

SEQ ID NO: 2898 - RNA, 19 nt, artificial
  Chemically Synthesized
cccuuucugcaguuggaag

SEQ ID NO: 2899 - RNA, 19 nt, artificial
  Chemically Synthesized
uauucuuugcacaacaaca

SEQ ID NO: 2900 - RNA, 19 nt, artificial
  Chemically Synthesized
uguccuugcaggcuucuga

SEQ ID NO: 2901 - RNA, 19 nt, artificial
  Chemically Synthesized
ucaacacggauaucagcau

SEQ ID NO: 2902 - RNA, 19 nt, artificial
  Chemically Synthesized
cugaacccaaauaaauaca

SEQ ID NO: 2903 - RNA, 19 nt, artificial
  Chemically Synthesized
caaguguguuuauugaaug

SEQ ID NO: 2904 - RNA, 19 nt, artificial
  Chemically Synthesized
gagaugucuauuucugcau

SEQ ID NO: 2905 - RNA, 19 nt, artificial
  Chemically Synthesized
guuuucuuguauaguggca

SEQ ID NO: 2906 - RNA, 19 nt, artificial
  Chemically Synthesized
accuugugaacucuuuaau

SEQ ID NO: 2907 - RNA, 19 nt, artificial
  Chemically Synthesized
cccaaucuaagcagacuuu

SEQ ID NO: 2908 - RNA, 19 nt, artificial
  Chemically Synthesized
acuuuuaaaugcccuuucu

SEQ ID NO: 2909 - RNA, 19 nt, artificial
  Chemically Synthesized
gugcugaacuuauuuuuca

SEQ ID NO: 2910 - RNA, 19 nt, artificial
  Chemically Synthesized
cggaaucuuuuaagugcug

SEQ ID NO: 2911 - RNA, 19 nt, artificial
  Chemically Synthesized
gucaaaugacagcaaagca

SEQ ID NO: 2912 - RNA, 19 nt, artificial
  Chemically Synthesized
uggugauugccugcuuuau

SEQ ID NO: 2913 - RNA, 19 nt, artificial
  Chemically Synthesized
auggugauugccugcuuua

SEQ ID NO: 2914 - RNA, 19 nt, artificial
  Chemically Synthesized
guggcagagaugucuauuu

SEQ ID NO: 2915 - RNA, 19 nt, artificial
  Chemically Synthesized
gaguuuucuuguauagugg

SEQ ID NO: 2916 - RNA, 19 nt, artificial
  Chemically Synthesized
agucuuuuggucagaaauu

SEQ ID NO: 2917 - RNA, 19 nt, artificial
  Chemically Synthesized
auacaacaugaacgacugc

SEQ ID NO: 2918 - RNA, 19 nt, artificial
  Chemically Synthesized
gguguucucuuacuuggac

SEQ ID NO: 2919 - RNA, 19 nt, artificial
  Chemically Synthesized
caggguguucucuuacuug

SEQ ID NO: 2920 - RNA, 19 nt, artificial
  Chemically Synthesized
aaaacagccugucggacca

SEQ ID NO: 2921 - RNA, 19 nt, artificial
  Chemically Synthesized
cacaacaacaacaacaaca

SEQ ID NO: 2922 - RNA, 19 nt, artificial
  Chemically Synthesized
gaccagugcuuugauuuuu

SEQ ID NO: 2923 - RNA, 19 nt, artificial
  Chemically Synthesized
cagcaugaaagccuucagu

SEQ ID NO: 2924 - RNA, 19 nt, artificial
  Chemically Synthesized
acggaaucuuuuaagugcu

SEQ ID NO: 2925 - RNA, 19 nt, artificial
  Chemically Synthesized
aacaacaaauucacggaau

SEQ ID NO: 2926 - RNA, 19 nt, artificial
  Chemically Synthesized
caacaacaacaaauucacg

SEQ ID NO: 2927 - RNA, 19 nt, artificial
  Chemically Synthesized
acaacaacaacaaauucac

SEQ ID NO: 2928 - RNA, 19 nt, artificial
  Chemically Synthesized
auucuuugcacaacaacaa

SEQ ID NO: 2929 - RNA, 19 nt, artificial
  Chemically Synthesized
aacaagaaggugagcaaga

SEQ ID NO: 2930 - RNA, 19 nt, artificial
  Chemically Synthesized
gcaugaaagccuucagucc

SEQ ID NO: 2931 - RNA, 19 nt, artificial
  Chemically Synthesized
uugccugcuuuauuucaga

SEQ ID NO: 2932 - RNA, 19 nt, artificial
  Chemically Synthesized
aggauccaguauucaguca

SEQ ID NO: 2933 - RNA, 19 nt, artificial
  Chemically Synthesized
cagaaggauccaguauuca

SEQ ID NO: 2934 - RNA, 19 nt, artificial
  Chemically Synthesized
ccagaaggauccaguauuc

SEQ ID NO: 2935 - RNA, 19 nt, artificial
  Chemically Synthesized
agcagacuuugccuuuuuu

SEQ ID NO: 2936 - RNA, 19 nt, artificial
  Chemically Synthesized
cacggauaucagcauccug

SEQ ID NO: 2937 - RNA, 19 nt, artificial
  Chemically Synthesized
gaaauuaccuuuuugacac

SEQ ID NO: 2938 - RNA, 19 nt, artificial
  Chemically Synthesized
ugagccugcuauacaacau

SEQ ID NO: 2939 - RNA, 19 nt, artificial
  Chemically Synthesized
gaugagccugcuauacaac

SEQ ID NO: 2940 - RNA, 19 nt, artificial
  Chemically Synthesized
cuuacuuggacugugauau

SEQ ID NO: 2941 - RNA, 19 nt, artificial
  Chemically Synthesized
cuucccaggguguucucuu

SEQ ID NO: 2942 - RNA, 19 nt, artificial
  Chemically Synthesized
cuuuuaagugcugaacuua

SEQ ID NO: 2943 - RNA, 19 nt, artificial
  Chemically Synthesized
gcuucugaauucccuucug

SEQ ID NO: 2944 - RNA, 19 nt, artificial
  Chemically Synthesized
gagcaagauggaaauccug

SEQ ID NO: 2945 - RNA, 19 nt, artificial
  Chemically Synthesized
aggaccagugcuuugauuu

SEQ ID NO: 2946 - RNA, 19 nt, artificial
  Chemically Synthesized
cugcuuuauuucagaggac

SEQ ID NO: 2947 - RNA, 19 nt, artificial
  Chemically Synthesized
uaguggcagagaugucuau

SEQ ID NO: 2948 - RNA, 19 nt, artificial
  Chemically Synthesized
ucuauuugagugaaaccuu

SEQ ID NO: 2949 - RNA, 19 nt, artificial
  Chemically Synthesized
gucagaaauuaccuuuuug

SEQ ID NO: 2950 - RNA, 19 nt, artificial
  Chemically Synthesized
cgugaauaccagaaggauc

SEQ ID NO: 2951 - RNA, 19 nt, artificial
  Chemically Synthesized
auugcccaaucuaagcaga

SEQ ID NO: 2952 - RNA, 19 nt, artificial
  Chemically Synthesized
aacguuaaaaucacaagga

SEQ ID NO: 2953 - RNA, 19 nt, artificial
  Chemically Synthesized
uauauacuauucccaccau

SEQ ID NO: 2954 - RNA, 19 nt, artificial
  Chemically Synthesized
cuuuauauacuauucccac

SEQ ID NO: 2955 - RNA, 19 nt, artificial
  Chemically Synthesized
uuacuuggacugugauauu

SEQ ID NO: 2956 - RNA, 19 nt, artificial
  Chemically Synthesized
guguucucuuacuuggacu

SEQ ID NO: 2957 - RNA, 19 nt, artificial
  Chemically Synthesized
cucaacacggauaucagca

SEQ ID NO: 2958 - RNA, 19 nt, artificial
  Chemically Synthesized
ucgacuacaucuuggaccu

SEQ ID NO: 2959 - RNA, 19 nt, artificial
  Chemically Synthesized
aaagccuucagucccguga

SEQ ID NO: 2960 - RNA, 19 nt, artificial
  Chemically Synthesized
agcacgucaucgacuacau

SEQ ID NO: 2961 - RNA, 19 nt, artificial
  Chemically Synthesized
augucuauuucugcauuca

SEQ ID NO: 2962 - RNA, 19 nt, artificial
  Chemically Synthesized
agaguuuucuuguauagug

SEQ ID NO: 2963 - RNA, 19 nt, artificial
  Chemically Synthesized
gagcgugaauaccagaagg

SEQ ID NO: 2964 - RNA, 19 nt, artificial
  Chemically Synthesized
cuaagcagacuuugccuuu

SEQ ID NO: 2965 - RNA, 19 nt, artificial
  Chemically Synthesized
uucugcaguuggaagguuu

SEQ ID NO: 2966 - RNA, 19 nt, artificial
  Chemically Synthesized
acaacaaauucacggaauc

SEQ ID NO: 2967 - RNA, 19 nt, artificial
  Chemically Synthesized
aauucccuucugaguuaau

SEQ ID NO: 2968 - RNA, 19 nt, artificial
  Chemically Synthesized
caucgacuacaucuuggac

SEQ ID NO: 2969 - RNA, 19 nt, artificial
  Chemically Synthesized
ugcagcacgucaucgacua

SEQ ID NO: 2970 - RNA, 19 nt, artificial
  Chemically Synthesized
ugacacaagccuacugaau

SEQ ID NO: 2971 - RNA, 19 nt, artificial
  Chemically Synthesized
ucuuugcacaacaacaaca

SEQ ID NO: 2972 - RNA, 19 nt, artificial
  Chemically Synthesized
guggcugaauaagcggugu

SEQ ID NO: 2973 - RNA, 19 nt, artificial
  Chemically Synthesized
acggauaucagcauccugu

SEQ ID NO: 2974 - RNA, 19 nt, artificial
  Chemically Synthesized
acucgcaucccacuauugu

SEQ ID NO: 2975 - RNA, 19 nt, artificial
  Chemically Synthesized
ugagugaaaccuugugaac

SEQ ID NO: 2976 - RNA, 19 nt, artificial
  Chemically Synthesized
ucuuuuggucagaaauuac

SEQ ID NO: 2977 - RNA, 19 nt, artificial
  Chemically Synthesized
ggauccaguauucagucac

SEQ ID NO: 2978 - RNA, 19 nt, artificial
  Chemically Synthesized
gaucaucuucccagggugu

SEQ ID NO: 2979 - RNA, 19 nt, artificial
  Chemically Synthesized
cacggaaucuuuuaagugc

SEQ ID NO: 2980 - RNA, 19 nt, artificial
  Chemically Synthesized
guuaggaaaaacagccugu

SEQ ID NO: 2981 - RNA, 19 nt, artificial
  Chemically Synthesized
cggauaucagcauccuguc

SEQ ID NO: 2982 - RNA, 19 nt, artificial
  Chemically Synthesized
cagaacaagaaggugagca

SEQ ID NO: 2983 - RNA, 19 nt, artificial
  Chemically Synthesized
guauaguggcagagauguc

SEQ ID NO: 2984 - RNA, 19 nt, artificial
  Chemically Synthesized
augaagucuuuuggucaga

SEQ ID NO: 2985 - RNA, 19 nt, artificial
  Chemically Synthesized
gcccaaucuaagcagacuu

SEQ ID NO: 2986 - RNA, 19 nt, artificial
  Chemically Synthesized
gagccugcuauacaacaug

SEQ ID NO: 2987 - RNA, 19 nt, artificial
  Chemically Synthesized
ccguuaggaaaaacagccu

SEQ ID NO: 2988 - RNA, 19 nt, artificial
  Chemically Synthesized
cucgcaucccacuauuguc

SEQ ID NO: 2989 - RNA, 19 nt, artificial
  Chemically Synthesized
cccagaacaagaaggugag

SEQ ID NO: 2990 - RNA, 19 nt, artificial
  Chemically Synthesized
acuccaagcucaaggagcu

SEQ ID NO: 2991 - RNA, 19 nt, artificial
  Chemically Synthesized
uauuugagugaaaccuugu

SEQ ID NO: 2992 - RNA, 19 nt, artificial
  Chemically Synthesized
cuuuuugacacaagccuac

SEQ ID NO: 2993 - RNA, 19 nt, artificial
  Chemically Synthesized
aaugaagucuuuuggucag

SEQ ID NO: 2994 - RNA, 19 nt, artificial
  Chemically Synthesized
uacaacaugaacgacugcu

SEQ ID NO: 2995 - RNA, 19 nt, artificial
  Chemically Synthesized
aaucacaaggaauugccca

SEQ ID NO: 2996 - RNA, 19 nt, artificial
  Chemically Synthesized
aaaugcccuuucugcaguu

SEQ ID NO: 2997 - RNA, 19 nt, artificial
  Chemically Synthesized
aggguguucucuuacuugg

SEQ ID NO: 2998 - RNA, 19 nt, artificial
  Chemically Synthesized
cuguguggcugaauaagcg

SEQ ID NO: 2999 - RNA, 19 nt, artificial
  Chemically Synthesized
aguuaaugucaaaugacag

SEQ ID NO: 3000 - RNA, 19 nt, artificial
  Chemically Synthesized
cugaauucccuucugaguu

SEQ ID NO: 3001 - RNA, 19 nt, artificial
  Chemically Synthesized
gacucgcaucccacuauug

SEQ ID NO: 3002 - RNA, 19 nt, artificial
  Chemically Synthesized
aguggcagagaugucuauu

SEQ ID NO: 3003 - RNA, 19 nt, artificial
  Chemically Synthesized
uguauaguggcagagaugu

SEQ ID NO: 3004 - RNA, 19 nt, artificial
  Chemically Synthesized
ucagucacuuaaaugaagu

SEQ ID NO: 3005 - RNA, 19 nt, artificial
  Chemically Synthesized
ucagcaugaaagccuucag

SEQ ID NO: 3006 - RNA, 19 nt, artificial
  Chemically Synthesized
ucaaaugacagcaaagcac

SEQ ID NO: 3007 - RNA, 19 nt, artificial
  Chemically Synthesized
uacaucuuggaccugcaga

SEQ ID NO: 3008 - RNA, 19 nt, artificial
  Chemically Synthesized
ggucagcaugaaagccuuc

SEQ ID NO: 3009 - RNA, 19 nt, artificial
  Chemically Synthesized
acgucaucgacuacaucuu

SEQ ID NO: 3010 - RNA, 19 nt, artificial
  Chemically Synthesized
cuuuauuucagaggaccag

SEQ ID NO: 3011 - RNA, 19 nt, artificial
  Chemically Synthesized
auaguggcagagaugucua

SEQ ID NO: 3012 - RNA, 19 nt, artificial
  Chemically Synthesized
uuugagugaaaccuuguga

SEQ ID NO: 3013 - RNA, 19 nt, artificial
  Chemically Synthesized
cuuuuaaaugcccuuucug

SEQ ID NO: 3014 - RNA, 19 nt, artificial
  Chemically Synthesized
ugaucaucuucccagggug

SEQ ID NO: 3015 - RNA, 19 nt, artificial
  Chemically Synthesized
aggaaaacuaagaaugauc

SEQ ID NO: 3016 - RNA, 19 nt, artificial
  Chemically Synthesized
acugaacccaaauaaauac

SEQ ID NO: 3017 - RNA, 19 nt, artificial
  Chemically Synthesized
auuucagaggaccagugcu

SEQ ID NO: 3018 - RNA, 19 nt, artificial
  Chemically Synthesized
agcgugaauaccagaagga

SEQ ID NO: 3019 - RNA, 19 nt, artificial
  Chemically Synthesized
acaaggaauugcccaaucu

SEQ ID NO: 3020 - RNA, 19 nt, artificial
  Chemically Synthesized
uucacaaggaggacaaguu

SEQ ID NO: 3021 - RNA, 19 nt, artificial
  Chemically Synthesized
auuucacaaggaggacaag

SEQ ID NO: 3022 - RNA, 19 nt, artificial
  Chemically Synthesized
ucaaccauuucacaaggag

SEQ ID NO: 3023 - RNA, 19 nt, artificial
  Chemically Synthesized
agcgguguucaugauuucu

SEQ ID NO: 3024 - RNA, 19 nt, artificial
  Chemically Synthesized
ugacagcaaagcacugugu

SEQ ID NO: 3025 - RNA, 19 nt, artificial
  Chemically Synthesized
cgucaucgacuacaucuug

SEQ ID NO: 3026 - RNA, 19 nt, artificial
  Chemically Synthesized
aaguguguuuauugaaugg

SEQ ID NO: 3027 - RNA, 19 nt, artificial
  Chemically Synthesized
acgacugcuacuccaagcu

SEQ ID NO: 3028 - RNA, 19 nt, artificial
  Chemically Synthesized
uggucagaaauuaccuuuu

SEQ ID NO: 3029 - RNA, 19 nt, artificial
  Chemically Synthesized
accagaaggauccaguauu

SEQ ID NO: 3030 - RNA, 19 nt, artificial
  Chemically Synthesized
cugcuauacaacaugaacg

SEQ ID NO: 3031 - RNA, 19 nt, artificial
  Chemically Synthesized
ggaauugcccaaucuaagc

SEQ ID NO: 3032 - RNA, 19 nt, artificial
  Chemically Synthesized
cuuucugcaguuggaaggu

SEQ ID NO: 3033 - RNA, 19 nt, artificial
  Chemically Synthesized
guguggcugaauaagcggu

SEQ ID NO: 3034 - RNA, 19 nt, artificial
  Chemically Synthesized
ucagaggaccagugcuuug

SEQ ID NO: 3035 - RNA, 19 nt, artificial
  Chemically Synthesized
uucagaggaccagugcuuu

SEQ ID NO: 3036 - RNA, 19 nt, artificial
  Chemically Synthesized
auugaauggugauugccug

SEQ ID NO: 3037 - RNA, 19 nt, artificial
  Chemically Synthesized
augauguacuuauucaugc

SEQ ID NO: 3038 - RNA, 19 nt, artificial
  Chemically Synthesized
gcagagaugucuauuucug

SEQ ID NO: 3039 - RNA, 19 nt, artificial
  Chemically Synthesized
uuguauaguggcagagaug

SEQ ID NO: 3040 - RNA, 19 nt, artificial
  Chemically Synthesized
uucagucacuuaaaugaag

SEQ ID NO: 3041 - RNA, 19 nt, artificial
  Chemically Synthesized
guauucagucacuuaaaug

SEQ ID NO: 3042 - RNA, 19 nt, artificial
  Chemically Synthesized
ugaauaccagaaggaucca

SEQ ID NO: 3043 - RNA, 19 nt, artificial
  Chemically Synthesized
gcagacuuugccuuuuuuc

SEQ ID NO: 3044 - RNA, 19 nt, artificial
  Chemically Synthesized
caucuucccaggguguucu

SEQ ID NO: 3045 - RNA, 19 nt, artificial
  Chemically Synthesized
uucacggaaucuuuuaagu

SEQ ID NO: 3046 - RNA, 19 nt, artificial
  Chemically Synthesized
uucugaauucccuucugag

SEQ ID NO: 3047 - RNA, 19 nt, artificial
  Chemically Synthesized
uggacucgcaucccacuau

SEQ ID NO: 3048 - RNA, 19 nt, artificial
  Chemically Synthesized
cugcuacuccaagcucaag

SEQ ID NO: 3049 - RNA, 19 nt, artificial
  Chemically Synthesized
gaauugcccaaucuaagca

SEQ ID NO: 3050 - RNA, 19 nt, artificial
  Chemically Synthesized
ugcaguuggaagguuuucu

SEQ ID NO: 3051 - RNA, 19 nt, artificial
  Chemically Synthesized
uuuaaaugcccuuucugca

SEQ ID NO: 3052 - RNA, 19 nt, artificial
  Chemically Synthesized
auaagcgguguucaugauu

SEQ ID NO: 3053 - RNA, 19 nt, artificial
  Chemically Synthesized
gucagcaugaaagccuuca

SEQ ID NO: 3054 - RNA, 19 nt, artificial
  Chemically Synthesized
gagguccguuaggaaaaac

SEQ ID NO: 3055 - RNA, 19 nt, artificial
  Chemically Synthesized
gcuauguuauaacugaacc

SEQ ID NO: 3056 - RNA, 19 nt, artificial
  Chemically Synthesized
uucugcauucaaaagugua

SEQ ID NO: 3057 - RNA, 19 nt, artificial
  Chemically Synthesized
cagagaugucuauuucugc

SEQ ID NO: 3058 - RNA, 19 nt, artificial
  Chemically Synthesized
uauaguggcagagaugucu

SEQ ID NO: 3059 - RNA, 19 nt, artificial
  Chemically Synthesized
uuauauacuauucccacca

SEQ ID NO: 3060 - RNA, 19 nt, artificial
  Chemically Synthesized
aagaaugaucaucuuccca

SEQ ID NO: 3061 - RNA, 19 nt, artificial
  Chemically Synthesized
agugcugaacuuauuuuuc

SEQ ID NO: 3062 - RNA, 19 nt, artificial
  Chemically Synthesized
augucaaaugacagcaaag

SEQ ID NO: 3063 - RNA, 19 nt, artificial
  Chemically Synthesized
gaugucuauuucugcauuc

SEQ ID NO: 3064 - RNA, 19 nt, artificial
  Chemically Synthesized
uuugacacaagccuacuga

SEQ ID NO: 3065 - RNA, 19 nt, artificial
  Chemically Synthesized
cuuaaaugaagucuuuugg

SEQ ID NO: 3066 - RNA, 19 nt, artificial
  Chemically Synthesized
gucacuuaaaugaagucuu

SEQ ID NO: 3067 - RNA, 19 nt, artificial
  Chemically Synthesized
caaucuaagcagacuuugc

SEQ ID NO: 3068 - RNA, 19 nt, artificial
  Chemically Synthesized
ccaaucuaagcagacuuug

SEQ ID NO: 3069 - RNA, 19 nt, artificial
  Chemically Synthesized
aaacguuaaaaucacaagg

SEQ ID NO: 3070 - RNA, 19 nt, artificial
  Chemically Synthesized
auauacuauucccaccaug

SEQ ID NO: 3071 - RNA, 19 nt, artificial
  Chemically Synthesized
augagccugcuauacaaca

SEQ ID NO: 3072 - RNA, 19 nt, artificial
  Chemically Synthesized
ugaauaagcgguguucaug

SEQ ID NO: 3073 - RNA, 19 nt, artificial
  Chemically Synthesized
uggcagagaugucuauuuc

SEQ ID NO: 3074 - RNA, 19 nt, artificial
  Chemically Synthesized
gacacaagccuacugaaug

SEQ ID NO: 3075 - RNA, 19 nt, artificial
  Chemically Synthesized
cagucacuuaaaugaaguc

SEQ ID NO: 3076 - RNA, 19 nt, artificial
  Chemically Synthesized
aagcagacuuugccuuuuu

SEQ ID NO: 3077 - RNA, 19 nt, artificial
  Chemically Synthesized
uggcugaauaagcgguguu

SEQ ID NO: 3078 - RNA, 19 nt, artificial
  Chemically Synthesized
ucugaauucccuucugagu

SEQ ID NO: 3079 - RNA, 19 nt, artificial
  Chemically Synthesized
uccuugcaggcuucugaau

SEQ ID NO: 3080 - RNA, 19 nt, artificial
  Chemically Synthesized
cgacuacaucuuggaccug

SEQ ID NO: 3081 - RNA, 19 nt, artificial
  Chemically Synthesized
caagauggaaauccugcag

SEQ ID NO: 3082 - RNA, 19 nt, artificial
  Chemically Synthesized
caugaaagccuucaguccc

SEQ ID NO: 3083 - RNA, 19 nt, artificial
  Chemically Synthesized
cuauguuauaacugaaccc

SEQ ID NO: 3084 - RNA, 19 nt, artificial
  Chemically Synthesized
cuauuucugcauucaaaag

SEQ ID NO: 3085 - RNA, 19 nt, artificial
  Chemically Synthesized
ucacaaggaauugcccaau

SEQ ID NO: 3086 - RNA, 19 nt, artificial
  Chemically Synthesized
gacuuuuaaaugcccuuuc

SEQ ID NO: 3087 - RNA, 19 nt, artificial
  Chemically Synthesized
uucaaccauuucacaagga

SEQ ID NO: 3088 - RNA, 19 nt, artificial
  Chemically Synthesized
caacaaauucacggaaucu

SEQ ID NO: 3089 - RNA, 19 nt, artificial
  Chemically Synthesized
cguuaggaaaaacagccug

SEQ ID NO: 3090 - RNA, 19 nt, artificial
  Chemically Synthesized
agcaaagcacuguguggcu

SEQ ID NO: 3091 - RNA, 19 nt, artificial
  Chemically Synthesized
guccguuaggaaaaacagc

SEQ ID NO: 3092 - RNA, 19 nt, artificial
  Chemically Synthesized
cuacaucuuggaccugcag

SEQ ID NO: 3093 - RNA, 19 nt, artificial
  Chemically Synthesized
uauguuauaacugaaccca

SEQ ID NO: 3094 - RNA, 19 nt, artificial
  Chemically Synthesized
uuucagaggaccagugcuu

SEQ ID NO: 3095 - RNA, 19 nt, artificial
  Chemically Synthesized
caaaaguguaaugauguac

SEQ ID NO: 3096 - RNA, 19 nt, artificial
  Chemically Synthesized
gugaacucuuuaauuagag

SEQ ID NO: 3097 - RNA, 19 nt, artificial
  Chemically Synthesized
gugaaaccuugugaacucu

SEQ ID NO: 3098 - RNA, 19 nt, artificial
  Chemically Synthesized
uuuggucagaaauuaccuu

SEQ ID NO: 3099 - RNA, 19 nt, artificial
  Chemically Synthesized
ugccuuuuuucaaaggugg

SEQ ID NO: 3100 - RNA, 19 nt, artificial
  Chemically Synthesized
aagacuuuuaaaugcccuu

SEQ ID NO: 3101 - RNA, 19 nt, artificial
  Chemically Synthesized
acuuggacugugauauucg

SEQ ID NO: 3102 - RNA, 19 nt, artificial
  Chemically Synthesized
aaaugacagcaaagcacug

SEQ ID NO: 3103 - RNA, 19 nt, artificial
  Chemically Synthesized
uuuauuucagaggaccagu

SEQ ID NO: 3104 - RNA, 19 nt, artificial
  Chemically Synthesized
guacuuauucaugcuaaac

SEQ ID NO: 3105 - RNA, 19 nt, artificial
  Chemically Synthesized
aacgacugcuacuccaagc

SEQ ID NO: 3106 - RNA, 19 nt, artificial
  Chemically Synthesized
uuuucaaccauuucacaag

SEQ ID NO: 3107 - RNA, 19 nt, artificial
  Chemically Synthesized
aucuuuuaagugcugaacu

SEQ ID NO: 3108 - RNA, 19 nt, artificial
  Chemically Synthesized
ugaguuaaugucaaaugac

SEQ ID NO: 3109 - RNA, 19 nt, artificial
  Chemically Synthesized
uucccuucugaguuaaugu

SEQ ID NO: 3110 - RNA, 19 nt, artificial
  Chemically Synthesized
acacggauaucagcauccu

SEQ ID NO: 3111 - RNA, 19 nt, artificial
  Chemically Synthesized
cgcaucccacuauugucag

SEQ ID NO: 3112 - RNA, 19 nt, artificial
  Chemically Synthesized
gauggaaauccugcagcac

SEQ ID NO: 3113 - RNA, 19 nt, artificial
  Chemically Synthesized
ccagaacaagaaggugagc

SEQ ID NO: 3114 - RNA, 19 nt, artificial
  Chemically Synthesized
uauugaauggugauugccu

SEQ ID NO: 3115 - RNA, 19 nt, artificial
  Chemically Synthesized
auuucugcauucaaaagug

SEQ ID NO: 3116 - RNA, 19 nt, artificial
  Chemically Synthesized
aauaccagaaggauccagu

SEQ ID NO: 3117 - RNA, 19 nt, artificial
  Chemically Synthesized
ugcccaaucuaagcagacu

SEQ ID NO: 3118 - RNA, 19 nt, artificial
  Chemically Synthesized
ggcugaauaagcgguguuc

SEQ ID NO: 3119 - RNA, 19 nt, artificial
  Chemically Synthesized
gucaucgacuacaucuugg

SEQ ID NO: 3120 - RNA, 19 nt, artificial
  Chemically Synthesized
cacgucaucgacuacaucu

SEQ ID NO: 3121 - RNA, 19 nt, artificial
  Chemically Synthesized
aauccugcagcacgucauc

SEQ ID NO: 3122 - RNA, 19 nt, artificial
  Chemically Synthesized
agugaaaccuugugaacuc

SEQ ID NO: 3123 - RNA, 19 nt, artificial
  Chemically Synthesized
uaagcagacuuugccuuuu

SEQ ID NO: 3124 - RNA, 19 nt, artificial
  Chemically Synthesized
uuggacugugauauucguu

SEQ ID NO: 3125 - RNA, 19 nt, artificial
  Chemically Synthesized
gcugaacuuauuuuucaac

SEQ ID NO: 3126 - RNA, 19 nt, artificial
  Chemically Synthesized
accacccucaacacggaua

SEQ ID NO: 3127 - RNA, 19 nt, artificial
  Chemically Synthesized
ugaaaccuugugaacucuu

SEQ ID NO: 3128 - RNA, 19 nt, artificial
  Chemically Synthesized
aaggauccaguauucaguc

SEQ ID NO: 3129 - RNA, 19 nt, artificial
  Chemically Synthesized
aaaucacaaggaauugccc

SEQ ID NO: 3130 - RNA, 19 nt, artificial
  Chemically Synthesized
cuuuuauucuuugcacaac

SEQ ID NO: 3131 - RNA, 19 nt, artificial
  Chemically Synthesized
aagcacuguguggcugaau

SEQ ID NO: 3132 - RNA, 19 nt, artificial
  Chemically Synthesized
auccuguccuugcaggcuu

SEQ ID NO: 3133 - RNA, 19 nt, artificial
  Chemically Synthesized
caacacggauaucagcauc

SEQ ID NO: 3134 - RNA, 19 nt, artificial
  Chemically Synthesized
cagcacgucaucgacuaca

SEQ ID NO: 3135 - RNA, 19 nt, artificial
  Chemically Synthesized
ugaaagccuucagucccgu

SEQ ID NO: 3136 - RNA, 19 nt, artificial
  Chemically Synthesized
ugauugccugcuuuauuuc

SEQ ID NO: 3137 - RNA, 19 nt, artificial
  Chemically Synthesized
ugcauucaaaaguguaaug

SEQ ID NO: 3138 - RNA, 19 nt, artificial
  Chemically Synthesized
uaccagaaggauccaguau

SEQ ID NO: 3139 - RNA, 19 nt, artificial
  Chemically Synthesized
uaaaugcccuuucugcagu

SEQ ID NO: 3140 - RNA, 19 nt, artificial
  Chemically Synthesized
cuaagaaugaucaucuucc

SEQ ID NO: 3141 - RNA, 19 nt, artificial
  Chemically Synthesized
gcaucccacuauugucagc

SEQ ID NO: 3142 - RNA, 19 nt, artificial
  Chemically Synthesized
aagaaggugagcaagaugg

SEQ ID NO: 3143 - RNA, 19 nt, artificial
  Chemically Synthesized
auuugagugaaaccuugug

SEQ ID NO: 3144 - RNA, 19 nt, artificial
  Chemically Synthesized
acacaagccuacugaaugc

SEQ ID NO: 3145 - RNA, 19 nt, artificial
  Chemically Synthesized
cugcaguuggaagguuuuc

SEQ ID NO: 3146 - RNA, 19 nt, artificial
  Chemically Synthesized
acagcaaagcacugugugg

SEQ ID NO: 3147 - RNA, 19 nt, artificial
  Chemically Synthesized
gacagcaaagcacugugug

SEQ ID NO: 3148 - RNA, 19 nt, artificial
  Chemically Synthesized
ggcuucugaauucccuucu

SEQ ID NO: 3149 - RNA, 19 nt, artificial
  Chemically Synthesized
uauugucagccugcaucac

SEQ ID NO: 3150 - RNA, 19 nt, artificial
  Chemically Synthesized
aucccacuauugucagccu

SEQ ID NO: 3151 - RNA, 19 nt, artificial
  Chemically Synthesized
uuuauugaauggugauugc

SEQ ID NO: 3152 - RNA, 19 nt, artificial
  Chemically Synthesized
aagccuacugaaugcugug

SEQ ID NO: 3153 - RNA, 19 nt, artificial
  Chemically Synthesized
uuuuggucagaaauuaccu

SEQ ID NO: 3154 - RNA, 19 nt, artificial
  Chemically Synthesized
ccuuuuuucaaagguggag

SEQ ID NO: 3155 - RNA, 19 nt, artificial
  Chemically Synthesized
acuuugccuuuuuucaaag

SEQ ID NO: 3156 - RNA, 19 nt, artificial
  Chemically Synthesized
ucccaggguguucucuuac

SEQ ID NO: 3157 - RNA, 19 nt, artificial
  Chemically Synthesized
ucaucuucccaggguguuc

SEQ ID NO: 3158 - RNA, 19 nt, artificial
  Chemically Synthesized
gaaaaacagccugucggac

SEQ ID NO: 3159 - RNA, 19 nt, artificial
  Chemically Synthesized
auucacggaaucuuuuaag

SEQ ID NO: 3160 - RNA, 19 nt, artificial
  Chemically Synthesized
uguggcugaauaagcggug

SEQ ID NO: 3161 - RNA, 19 nt, artificial
  Chemically Synthesized
guuaaugucaaaugacagc

SEQ ID NO: 3162 - RNA, 19 nt, artificial
  Chemically Synthesized
gauaucagcauccuguccu

SEQ ID NO: 3163 - RNA, 19 nt, artificial
  Chemically Synthesized
aguuuucuuguauaguggc

SEQ ID NO: 3164 - RNA, 19 nt, artificial
  Chemically Synthesized
aaagacuuuuaaaugcccu

SEQ ID NO: 3165 - RNA, 19 nt, artificial
  Chemically Synthesized
uaagaaugaucaucuuccc

SEQ ID NO: 3166 - RNA, 19 nt, artificial
  Chemically Synthesized
accauuucacaaggaggac

SEQ ID NO: 3167 - RNA, 19 nt, artificial
  Chemically Synthesized
uguguggcugaauaagcgg

SEQ ID NO: 3168 - RNA, 19 nt, artificial
  Chemically Synthesized
ggugagcaagauggaaauc

SEQ ID NO: 3169 - RNA, 19 nt, artificial
  Chemically Synthesized
guuuauugaauggugauug

SEQ ID NO: 3170 - RNA, 19 nt, artificial
  Chemically Synthesized
uguucucuuacuuggacug

SEQ ID NO: 3171 - RNA, 19 nt, artificial
  Chemically Synthesized
ggauaucagcauccugucc

SEQ ID NO: 3172 - RNA, 19 nt, artificial
  Chemically Synthesized
acuauugucagccugcauc

SEQ ID NO: 3173 - RNA, 19 nt, artificial
  Chemically Synthesized
ugcuauguuauaacugaac

SEQ ID NO: 3174 - RNA, 19 nt, artificial
  Chemically Synthesized
aguguguuuauugaauggu

SEQ ID NO: 3175 - RNA, 19 nt, artificial
  Chemically Synthesized
uugccuuuuuucaaaggug

SEQ ID NO: 3176 - RNA, 19 nt, artificial
  Chemically Synthesized
ccuuucugcaguuggaagg

SEQ ID NO: 3177 - RNA, 19 nt, artificial
  Chemically Synthesized
uuucacaaggaggacaagu

SEQ ID NO: 3178 - RNA, 19 nt, artificial
  Chemically Synthesized
uuucaaccauuucacaagg

SEQ ID NO: 3179 - RNA, 19 nt, artificial
  Chemically Synthesized
aggaaaaacagccugucgg

SEQ ID NO: 3180 - RNA, 19 nt, artificial
  Chemically Synthesized
gacuacaucuuggaccugc

SEQ ID NO: 3181 - RNA, 19 nt, artificial
  Chemically Synthesized
ugcuuuauuucagaggacc

SEQ ID NO: 3182 - RNA, 19 nt, artificial
  Chemically Synthesized
uaucuauuugagugaaacc

SEQ ID NO: 3183 - RNA, 19 nt, artificial
  Chemically Synthesized
accuuuuugacacaagccu

SEQ ID NO: 3184 - RNA, 19 nt, artificial
  Chemically Synthesized
uuaccuuuuugacacaagc

SEQ ID NO: 3185 - RNA, 19 nt, artificial
  Chemically Synthesized
uaaaugaagucuuuugguc

SEQ ID NO: 3186 - RNA, 19 nt, artificial
  Chemically Synthesized
aucuaagcagacuuugccu

SEQ ID NO: 3187 - RNA, 19 nt, artificial
  Chemically Synthesized
guucucuuacuuggacugu

SEQ ID NO: 3188 - RNA, 19 nt, artificial
  Chemically Synthesized
aacaaauucacggaaucuu

SEQ ID NO: 3189 - RNA, 19 nt, artificial
  Chemically Synthesized
uuauuucagaggaccagug

SEQ ID NO: 3190 - RNA, 19 nt, artificial
  Chemically Synthesized
uuucugcauucaaaagugu

SEQ ID NO: 3191 - RNA, 19 nt, artificial
  Chemically Synthesized
agacuuuuaaaugcccuuu

SEQ ID NO: 3192 - RNA, 19 nt, artificial
  Chemically Synthesized
uucucuuacuuggacugug

SEQ ID NO: 3193 - RNA, 19 nt, artificial
  Chemically Synthesized
ucuucccaggguguucucu

SEQ ID NO: 3194 - RNA, 19 nt, artificial
  Chemically Synthesized
agaaugaucaucuucccag

SEQ ID NO: 3195 - RNA, 19 nt, artificial
  Chemically Synthesized
aaucuuuuaagugcugaac

SEQ ID NO: 3196 - RNA, 19 nt, artificial
  Chemically Synthesized
auggaaauccugcagcacg

SEQ ID NO: 3197 - RNA, 19 nt, artificial
  Chemically Synthesized
uuuuugacacaagccuacu

SEQ ID NO: 3198 - RNA, 19 nt, artificial
  Chemically Synthesized
uuggucagaaauuaccuuu

SEQ ID NO: 3199 - RNA, 19 nt, artificial
  Chemically Synthesized
gaauaccagaaggauccag

SEQ ID NO: 3200 - RNA, 19 nt, artificial
  Chemically Synthesized
uugcacaacaacaacaaca

SEQ ID NO: 3201 - RNA, 19 nt, artificial
  Chemically Synthesized
uucuuugcacaacaacaac

SEQ ID NO: 3202 - RNA, 19 nt, artificial
  Chemically Synthesized
uuaaugucaaaugacagca

SEQ ID NO: 3203 - RNA, 19 nt, artificial
  Chemically Synthesized
cacccucaacacggauauc

SEQ ID NO: 3204 - RNA, 19 nt, artificial
  Chemically Synthesized
cuacuccaagcucaaggag

SEQ ID NO: 3205 - RNA, 19 nt, artificial
  Chemically Synthesized
uuucugcaguuggaagguu

SEQ ID NO: 3206 - RNA, 19 nt, artificial
  Chemically Synthesized
uaguuguaaacuuaacccu

SEQ ID NO: 3207 - RNA, 19 nt, artificial
  Chemically Synthesized
ucguucauguuguauagca

SEQ ID NO: 3208 - RNA, 19 nt, artificial
  Chemically Synthesized
uggaguagcagucguucau

SEQ ID NO: 3209 - RNA, 19 nt, artificial
  Chemically Synthesized
uagcagucguucauguugu

SEQ ID NO: 3210 - RNA, 19 nt, artificial
  Chemically Synthesized
uuuggguucaguuauaaca

SEQ ID NO: 3211 - RNA, 19 nt, artificial
  Chemically Synthesized
uucauguuguauagcaggc

SEQ ID NO: 3212 - RNA, 19 nt, artificial
  Chemically Synthesized
uugacauuaacucagaagg

SEQ ID NO: 3213 - RNA, 19 nt, artificial
  Chemically Synthesized
uuugaaugcagaaauagac

SEQ ID NO: 3214 - RNA, 19 nt, artificial
  Chemically Synthesized
ugugauuuuaacguuuucg

SEQ ID NO: 3215 - RNA, 19 nt, artificial
  Chemically Synthesized
uuggaguagcagucguuca

SEQ ID NO: 3216 - RNA, 19 nt, artificial
  Chemically Synthesized
guagcagucguucauguug

SEQ ID NO: 3217 - RNA, 19 nt, artificial
  Chemically Synthesized
agucguucauguuguauag

SEQ ID NO: 3218 - RNA, 19 nt, artificial
  Chemically Synthesized
cagucguucauguuguaua

SEQ ID NO: 3219 - RNA, 19 nt, artificial
  Chemically Synthesized
auuccuugugauuuuaacg

SEQ ID NO: 3220 - RNA, 19 nt, artificial
  Chemically Synthesized
ucauucuuaguuuuccuuc

SEQ ID NO: 3221 - RNA, 19 nt, artificial
  Chemically Synthesized
uucagcacuuaaaagauuc

SEQ ID NO: 3222 - RNA, 19 nt, artificial
  Chemically Synthesized
uuugaaaaaaggcaaaguc

SEQ ID NO: 3223 - RNA, 19 nt, artificial
  Chemically Synthesized
aaggcuuucaugcugaccg

SEQ ID NO: 3224 - RNA, 19 nt, artificial
  Chemically Synthesized
uuccuugugauuuuaacgu

SEQ ID NO: 3225 - RNA, 19 nt, artificial
  Chemically Synthesized
uccaaguaagagaacaccc

SEQ ID NO: 3226 - RNA, 19 nt, artificial
  Chemically Synthesized
auacacagcauucaguagg

SEQ ID NO: 3227 - RNA, 19 nt, artificial
  Chemically Synthesized
uuucugaccaaaagacuuc

SEQ ID NO: 3228 - RNA, 19 nt, artificial
  Chemically Synthesized
uuaagugacugaauacugg

SEQ ID NO: 3229 - RNA, 19 nt, artificial
  Chemically Synthesized
uuuaagugacugaauacug

SEQ ID NO: 3230 - RNA, 19 nt, artificial
  Chemically Synthesized
uagauugggcaauuccuug

SEQ ID NO: 3231 - RNA, 19 nt, artificial
  Chemically Synthesized
cuuggaguagcagucguuc

SEQ ID NO: 3232 - RNA, 19 nt, artificial
  Chemically Synthesized
auuuuaacguuuucgcucc

SEQ ID NO: 3233 - RNA, 19 nt, artificial
  Chemically Synthesized
cuuguauuuauuuggguuc

SEQ ID NO: 3234 - RNA, 19 nt, artificial
  Chemically Synthesized
gucguucauguuguauagc

SEQ ID NO: 3235 - RNA, 19 nt, artificial
  Chemically Synthesized
uuagauugggcaauuccuu

SEQ ID NO: 3236 - RNA, 19 nt, artificial
  Chemically Synthesized
uccaucuugcucaccuucu

SEQ ID NO: 3237 - RNA, 19 nt, artificial
  Chemically Synthesized
uugagcuuggaguagcagu

SEQ ID NO: 3238 - RNA, 19 nt, artificial
  Chemically Synthesized
uuuuaacguuuucgcuccc

SEQ ID NO: 3239 - RNA, 19 nt, artificial
  Chemically Synthesized
auaacgaauaucacagucc

SEQ ID NO: 3240 - RNA, 19 nt, artificial
  Chemically Synthesized
auaaaaaucaaagcacugg

SEQ ID NO: 3241 - RNA, 19 nt, artificial
  Chemically Synthesized
ggaguagcagucguucaug

SEQ ID NO: 3242 - RNA, 19 nt, artificial
  Chemically Synthesized
uaggcuugugucaaaaagg

SEQ ID NO: 3243 - RNA, 19 nt, artificial
  Chemically Synthesized
uucagaagccugcaaggac

SEQ ID NO: 3244 - RNA, 19 nt, artificial
  Chemically Synthesized
uuuuuccuaacggaccuca

SEQ ID NO: 3245 - RNA, 19 nt, artificial
  Chemically Synthesized
ugaucauucuuaguuuucc

SEQ ID NO: 3246 - RNA, 19 nt, artificial
  Chemically Synthesized
uuuuccuaacggaccucac

SEQ ID NO: 3247 - RNA, 19 nt, artificial
  Chemically Synthesized
auaaagaaaaccuuccaac

SEQ ID NO: 3248 - RNA, 19 nt, artificial
  Chemically Synthesized
uuguccuccuugugaaaug

SEQ ID NO: 3249 - RNA, 19 nt, artificial
  Chemically Synthesized
uccgacaggcuguuuuucc

SEQ ID NO: 3250 - RNA, 19 nt, artificial
  Chemically Synthesized
auuuccaucuugcucaccu

SEQ ID NO: 3251 - RNA, 19 nt, artificial
  Chemically Synthesized
aauaaagcaggcaaucacc

SEQ ID NO: 3252 - RNA, 19 nt, artificial
  Chemically Synthesized
agcaugaauaaguacauca

SEQ ID NO: 3253 - RNA, 19 nt, artificial
  Chemically Synthesized
aucucugccacuauacaag

SEQ ID NO: 3254 - RNA, 19 nt, artificial
  Chemically Synthesized
aauuaaagaguucacaagg

SEQ ID NO: 3255 - RNA, 19 nt, artificial
  Chemically Synthesized
ucauguuguauagcaggcu

SEQ ID NO: 3256 - RNA, 19 nt, artificial
  Chemically Synthesized
uuccaacugcagaaagggc

SEQ ID NO: 3257 - RNA, 19 nt, artificial
  Chemically Synthesized
uuccgugaauuuguuguug

SEQ ID NO: 3258 - RNA, 19 nt, artificial
  Chemically Synthesized
augaacaccgcuuauucag

SEQ ID NO: 3259 - RNA, 19 nt, artificial
  Chemically Synthesized
ugucauuugacauuaacuc

SEQ ID NO: 3260 - RNA, 19 nt, artificial
  Chemically Synthesized
uuggguucaguuauaacau

SEQ ID NO: 3261 - RNA, 19 nt, artificial
  Chemically Synthesized
uugaaugcagaaauagaca

SEQ ID NO: 3262 - RNA, 19 nt, artificial
  Chemically Synthesized
auccuucugguauucacgc

SEQ ID NO: 3263 - RNA, 19 nt, artificial
  Chemically Synthesized
uauucacgcuccaccuuug

SEQ ID NO: 3264 - RNA, 19 nt, artificial
  Chemically Synthesized
guucauguuguauagcagg

SEQ ID NO: 3265 - RNA, 19 nt, artificial
  Chemically Synthesized
uagcaugaauaaguacauc

SEQ ID NO: 3266 - RNA, 19 nt, artificial
  Chemically Synthesized
acugaauacuggauccuuc

SEQ ID NO: 3267 - RNA, 19 nt, artificial
  Chemically Synthesized
uaaaaaucaaagcacuggu

SEQ ID NO: 3268 - RNA, 19 nt, artificial
  Chemically Synthesized
aaaaucaaagcacuggucc

SEQ ID NO: 3269 - RNA, 19 nt, artificial
  Chemically Synthesized
ucaccauucaauaaacaca

SEQ ID NO: 3270 - RNA, 19 nt, artificial
  Chemically Synthesized
ugagcuuggaguagcaguc

SEQ ID NO: 3271 - RNA, 19 nt, artificial
  Chemically Synthesized
uuacacuuuugaaugcaga

SEQ ID NO: 3272 - RNA, 19 nt, artificial
  Chemically Synthesized
uuguuguuguugugcaaag

SEQ ID NO: 3273 - RNA, 19 nt, artificial
  Chemically Synthesized
uuugcugucauuugacauu

SEQ ID NO: 3274 - RNA, 19 nt, artificial
  Chemically Synthesized
ugguccucugaaauaaagc

SEQ ID NO: 3275 - RNA, 19 nt, artificial
  Chemically Synthesized
uauauacacagcauucagu

SEQ ID NO: 3276 - RNA, 19 nt, artificial
  Chemically Synthesized
uauagcaggcucaucgggu

SEQ ID NO: 3277 - RNA, 19 nt, artificial
  Chemically Synthesized
aucaaagcacugguccucu

SEQ ID NO: 3278 - RNA, 19 nt, artificial
  Chemically Synthesized
uaaagaguucacaagguuu

SEQ ID NO: 3279 - RNA, 19 nt, artificial
  Chemically Synthesized
aguagcagucguucauguu

SEQ ID NO: 3280 - RNA, 19 nt, artificial
  Chemically Synthesized
uaaagaaaaccuuccaacu

SEQ ID NO: 3281 - RNA, 19 nt, artificial
  Chemically Synthesized
acgaauaucacaguccaag

SEQ ID NO: 3282 - RNA, 19 nt, artificial
  Chemically Synthesized
aaguaagagaacacccugg

SEQ ID NO: 3283 - RNA, 19 nt, artificial
  Chemically Synthesized
ucaacuuguccuccuugug

SEQ ID NO: 3284 - RNA, 19 nt, artificial
  Chemically Synthesized
gaguagcagucguucaugu

SEQ ID NO: 3285 - RNA, 19 nt, artificial
  Chemically Synthesized
ugcaggauuuccaucuugc

SEQ ID NO: 3286 - RNA, 19 nt, artificial
  Chemically Synthesized
aaagaguucacaagguuuc

SEQ ID NO: 3287 - RNA, 19 nt, artificial
  Chemically Synthesized
aagaaaaccuuccaacugc

SEQ ID NO: 3288 - RNA, 19 nt, artificial
  Chemically Synthesized
ugaugcaggcugacaauag

SEQ ID NO: 3289 - RNA, 19 nt, artificial
  Chemically Synthesized
ugcaggcugacaauagugg

SEQ ID NO: 3290 - RNA, 19 nt, artificial
  Chemically Synthesized
ugcagaaauagacaucucu

SEQ ID NO: 3291 - RNA, 19 nt, artificial
  Chemically Synthesized
auauauacacagcauucag

SEQ ID NO: 3292 - RNA, 19 nt, artificial
  Chemically Synthesized
uucaguaggcuugugucaa

SEQ ID NO: 3293 - RNA, 19 nt, artificial
  Chemically Synthesized
uuguuguuguuguugugca

SEQ ID NO: 3294 - RNA, 19 nt, artificial
  Chemically Synthesized
auuuggguucaguuauaac

SEQ ID NO: 3295 - RNA, 19 nt, artificial
  Chemically Synthesized
uucacaagguuucacucaa

SEQ ID NO: 3296 - RNA, 19 nt, artificial
  Chemically Synthesized
ucacgcuccaccuuugaaa

SEQ ID NO: 3297 - RNA, 19 nt, artificial
  Chemically Synthesized
ccugggaagaugaucauuc

SEQ ID NO: 3298 - RNA, 19 nt, artificial
  Chemically Synthesized
uucagccacacagugcuuu

SEQ ID NO: 3299 - RNA, 19 nt, artificial
  Chemically Synthesized
uggugaugcaggcugacaa

SEQ ID NO: 3300 - RNA, 19 nt, artificial
  Chemically Synthesized
ugcugcaggauuuccaucu

SEQ ID NO: 3301 - RNA, 19 nt, artificial
  Chemically Synthesized
aaucaaagcacugguccuc

SEQ ID NO: 3302 - RNA, 19 nt, artificial
  Chemically Synthesized
agugacugaauacuggauc

SEQ ID NO: 3303 - RNA, 19 nt, artificial
  Chemically Synthesized
cuguuuuuccuaacggacc

SEQ ID NO: 3304 - RNA, 19 nt, artificial
  Chemically Synthesized
aaauaaagcaggcaaucac

SEQ ID NO: 3305 - RNA, 19 nt, artificial
  Chemically Synthesized
aagcaggcaaucaccauuc

SEQ ID NO: 3306 - RNA, 19 nt, artificial
  Chemically Synthesized
aucaccauucaauaaacac

SEQ ID NO: 3307 - RNA, 19 nt, artificial
  Chemically Synthesized
uugaaaaaaggcaaagucu

SEQ ID NO: 3308 - RNA, 19 nt, artificial
  Chemically Synthesized
ucacaguccaaguaagaga

SEQ ID NO: 3309 - RNA, 19 nt, artificial
  Chemically Synthesized
agaaauagacaucucugcc

SEQ ID NO: 3310 - RNA, 19 nt, artificial
  Chemically Synthesized
ucagccacacagugcuuug

SEQ ID NO: 3311 - RNA, 19 nt, artificial
  Chemically Synthesized
acagcauucaguaggcuug

SEQ ID NO: 3312 - RNA, 19 nt, artificial
  Chemically Synthesized
uucugguauucacgcucca

SEQ ID NO: 3313 - RNA, 19 nt, artificial
  Chemically Synthesized
uaagagaacacccugggaa

SEQ ID NO: 3314 - RNA, 19 nt, artificial
  Chemically Synthesized
uugcugucauuugacauua

SEQ ID NO: 3315 - RNA, 19 nt, artificial
  Chemically Synthesized
ucaaagcacugguccucug

SEQ ID NO: 3316 - RNA, 19 nt, artificial
  Chemically Synthesized
cuucugguauucacgcucc

SEQ ID NO: 3317 - RNA, 19 nt, artificial
  Chemically Synthesized
ugauuuuaacguuuucgcu

SEQ ID NO: 3318 - RNA, 19 nt, artificial
  Chemically Synthesized
gauuuuaacguuuucgcuc

SEQ ID NO: 3319 - RNA, 19 nt, artificial
  Chemically Synthesized
aaagaaaaccuuccaacug

SEQ ID NO: 3320 - RNA, 19 nt, artificial
  Chemically Synthesized
uaacgaauaucacagucca

SEQ ID NO: 3321 - RNA, 19 nt, artificial
  Chemically Synthesized
aguaagagaacacccuggg

SEQ ID NO: 3322 - RNA, 19 nt, artificial
  Chemically Synthesized
ucagcacuuaaaagauucc

SEQ ID NO: 3323 - RNA, 19 nt, artificial
  Chemically Synthesized
agugcuuugcugucauuug

SEQ ID NO: 3324 - RNA, 19 nt, artificial
  Chemically Synthesized
ugaaauaaagcaggcaauc

SEQ ID NO: 3325 - RNA, 19 nt, artificial
  Chemically Synthesized
aaaggguuaaguuuacaac

SEQ ID NO: 3326 - RNA, 19 nt, artificial
  Chemically Synthesized
uuaaagaguucacaagguu

SEQ ID NO: 3327 - RNA, 19 nt, artificial
  Chemically Synthesized
auauacacagcauucagua

SEQ ID NO: 3328 - RNA, 19 nt, artificial
  Chemically Synthesized
auuucugaccaaaagacuu

SEQ ID NO: 3329 - RNA, 19 nt, artificial
  Chemically Synthesized
uccaacugcagaaagggca

SEQ ID NO: 3330 - RNA, 19 nt, artificial
  Chemically Synthesized
auucuuaguuuuccuucca

SEQ ID NO: 3331 - RNA, 19 nt, artificial
  Chemically Synthesized
aaggguuaaguuuacaacu

SEQ ID NO: 3332 - RNA, 19 nt, artificial
  Chemically Synthesized
uacacagcauucaguaggc

SEQ ID NO: 3333 - RNA, 19 nt, artificial
  Chemically Synthesized
ugaccaaaagacuucauuu

SEQ ID NO: 3334 - RNA, 19 nt, artificial
  Chemically Synthesized
ugaaaaaaggcaaagucug

SEQ ID NO: 3335 - RNA, 19 nt, artificial
  Chemically Synthesized
aaagauuccgugaauuugu

SEQ ID NO: 3336 - RNA, 19 nt, artificial
  Chemically Synthesized
aaaagaaaucaugaacacc

SEQ ID NO: 3337 - RNA, 19 nt, artificial
  Chemically Synthesized
uguuuuuccuaacggaccu

SEQ ID NO: 3338 - RNA, 19 nt, artificial
  Chemically Synthesized
ugcagguccaagauguagu

SEQ ID NO: 3339 - RNA, 19 nt, artificial
  Chemically Synthesized
uccucugaaauaaagcagg

SEQ ID NO: 3340 - RNA, 19 nt, artificial
  Chemically Synthesized
aaugcagaaauagacaucu

SEQ ID NO: 3341 - RNA, 19 nt, artificial
  Chemically Synthesized
caagguuucacucaaauag

SEQ ID NO: 3342 - RNA, 19 nt, artificial
  Chemically Synthesized
ucugguauucacgcuccac

SEQ ID NO: 3343 - RNA, 19 nt, artificial
  Chemically Synthesized
uccaccuuugaaaaaaggc

SEQ ID NO: 3344 - RNA, 19 nt, artificial
  Chemically Synthesized
aucacaguccaaguaagag

SEQ ID NO: 3345 - RNA, 19 nt, artificial
  Chemically Synthesized
uccaagauguagucgauga

SEQ ID NO: 3346 - RNA, 19 nt, artificial
  Chemically Synthesized
cuugcucaccuucuuguuc

SEQ ID NO: 3347 - RNA, 19 nt, artificial
  Chemically Synthesized
auuacacuuuugaaugcag

SEQ ID NO: 3348 - RNA, 19 nt, artificial
  Chemically Synthesized
ugguauucacgcuccaccu

SEQ ID NO: 3349 - RNA, 19 nt, artificial
  Chemically Synthesized
uaucacaguccaaguaaga

SEQ ID NO: 3350 - RNA, 19 nt, artificial
  Chemically Synthesized
uguccuccuugugaaaugg

SEQ ID NO: 3351 - RNA, 19 nt, artificial
  Chemically Synthesized
ugacauuaacucagaaggg

SEQ ID NO: 3352 - RNA, 19 nt, artificial
  Chemically Synthesized
uaagugacugaauacugga

SEQ ID NO: 3353 - RNA, 19 nt, artificial
  Chemically Synthesized
aaaaccuuccaacugcaga

SEQ ID NO: 3354 - RNA, 19 nt, artificial
  Chemically Synthesized
aauaacgaauaucacaguc

SEQ ID NO: 3355 - RNA, 19 nt, artificial
  Chemically Synthesized
cugauauccguguugaggg

SEQ ID NO: 3356 - RNA, 19 nt, artificial
  Chemically Synthesized
uccuugagcuuggaguagc

SEQ ID NO: 3357 - RNA, 19 nt, artificial
  Chemically Synthesized
uaauuucugaccaaaagac

SEQ ID NO: 3358 - RNA, 19 nt, artificial
  Chemically Synthesized
uacuggauccuucugguau

SEQ ID NO: 3359 - RNA, 19 nt, artificial
  Chemically Synthesized
aaguucagcacuuaaaaga

SEQ ID NO: 3360 - RNA, 19 nt, artificial
  Chemically Synthesized
uccgugaauuuguuguugu

SEQ ID NO: 3361 - RNA, 19 nt, artificial
  Chemically Synthesized
augacgugcugcaggauuu

SEQ ID NO: 3362 - RNA, 19 nt, artificial
  Chemically Synthesized
gaacuuguauuuauuuggg

SEQ ID NO: 3363 - RNA, 19 nt, artificial
  Chemically Synthesized
uauacacagcauucaguag

SEQ ID NO: 3364 - RNA, 19 nt, artificial
  Chemically Synthesized
aaaaagguaauuucugacc

SEQ ID NO: 3365 - RNA, 19 nt, artificial
  Chemically Synthesized
uucugaccaaaagacuuca

SEQ ID NO: 3366 - RNA, 19 nt, artificial
  Chemically Synthesized
cugaauacuggauccuucu

SEQ ID NO: 3367 - RNA, 19 nt, artificial
  Chemically Synthesized
auucacgcuccaccuuuga

SEQ ID NO: 3368 - RNA, 19 nt, artificial
  Chemically Synthesized
uucacgcuccaccuuugaa

SEQ ID NO: 3369 - RNA, 19 nt, artificial
  Chemically Synthesized
cauucuuaguuuuccuucc

SEQ ID NO: 3370 - RNA, 19 nt, artificial
  Chemically Synthesized
ugaacaccgcuuauucagc

SEQ ID NO: 3371 - RNA, 19 nt, artificial
  Chemically Synthesized
cuuauucagccacacagug

SEQ ID NO: 3372 - RNA, 19 nt, artificial
  Chemically Synthesized
aagggaauucagaagccug

SEQ ID NO: 3373 - RNA, 19 nt, artificial
  Chemically Synthesized
ugacgugcugcaggauuuc

SEQ ID NO: 3374 - RNA, 19 nt, artificial
  Chemically Synthesized
aaagcaggcaaucaccauu

SEQ ID NO: 3375 - RNA, 19 nt, artificial
  Chemically Synthesized
ucugccacuauacaagaaa

SEQ ID NO: 3376 - RNA, 19 nt, artificial
  Chemically Synthesized
gucaaaaagguaauuucug

SEQ ID NO: 3377 - RNA, 19 nt, artificial
  Chemically Synthesized
agggaauucagaagccugc

SEQ ID NO: 3378 - RNA, 19 nt, artificial
  Chemically Synthesized
ugcaaggacaggaugcuga

SEQ ID NO: 3379 - RNA, 19 nt, artificial
  Chemically Synthesized
augcaggcugacaauagug

SEQ ID NO: 3380 - RNA, 19 nt, artificial
  Chemically Synthesized
ucucugccacuauacaaga

SEQ ID NO: 3381 - RNA, 19 nt, artificial
  Chemically Synthesized
guauucacgcuccaccuuu

SEQ ID NO: 3382 - RNA, 19 nt, artificial
  Chemically Synthesized
uugggcaauuccuugugau

SEQ ID NO: 3383 - RNA, 19 nt, artificial
  Chemically Synthesized
gugauuuuaacguuuucgc

SEQ ID NO: 3384 - RNA, 19 nt, artificial
  Chemically Synthesized
aaaagauuccgugaauuug

SEQ ID NO: 3385 - RNA, 19 nt, artificial
  Chemically Synthesized
aaggacaggaugcugauau

SEQ ID NO: 3386 - RNA, 19 nt, artificial
  Chemically Synthesized
gcugauauccguguugagg

SEQ ID NO: 3387 - RNA, 19 nt, artificial
  Chemically Synthesized
acgugcugcaggauuucca

SEQ ID NO: 3388 - RNA, 19 nt, artificial
  Chemically Synthesized
caccauucaauaaacacac

SEQ ID NO: 3389 - RNA, 19 nt, artificial
  Chemically Synthesized
ucauuacacuuuugaaugc

SEQ ID NO: 3390 - RNA, 19 nt, artificial
  Chemically Synthesized
aguucacaagguuucacuc

SEQ ID NO: 3391 - RNA, 19 nt, artificial
  Chemically Synthesized
cuuagauugggcaauuccu

SEQ ID NO: 3392 - RNA, 19 nt, artificial
  Chemically Synthesized
uccuccuugugaaaugguu

SEQ ID NO: 3393 - RNA, 19 nt, artificial
  Chemically Synthesized
ccuccuugugaaaugguug

SEQ ID NO: 3394 - RNA, 19 nt, artificial
  Chemically Synthesized
aagaaaucaugaacaccgc

SEQ ID NO: 3395 - RNA, 19 nt, artificial
  Chemically Synthesized
aauucagaagccugcaagg

SEQ ID NO: 3396 - RNA, 19 nt, artificial
  Chemically Synthesized
auauccguguugagggugg

SEQ ID NO: 3397 - RNA, 19 nt, artificial
  Chemically Synthesized
aucugcagguccaagaugu

SEQ ID NO: 3398 - RNA, 19 nt, artificial
  Chemically Synthesized
cuuccaacugcagaaaggg

SEQ ID NO: 3399 - RNA, 19 nt, artificial
  Chemically Synthesized
uguuguugugcaaagaaua

SEQ ID NO: 3400 - RNA, 19 nt, artificial
  Chemically Synthesized
ucagaagccugcaaggaca

SEQ ID NO: 3401 - RNA, 19 nt, artificial
  Chemically Synthesized
augcugauauccguguuga

SEQ ID NO: 3402 - RNA, 19 nt, artificial
  Chemically Synthesized
uguauuuauuuggguucag

SEQ ID NO: 3403 - RNA, 19 nt, artificial
  Chemically Synthesized
cauucaauaaacacacuug

SEQ ID NO: 3404 - RNA, 19 nt, artificial
  Chemically Synthesized
augcagaaauagacaucuc

SEQ ID NO: 3405 - RNA, 19 nt, artificial
  Chemically Synthesized
ugccacuauacaagaaaac

SEQ ID NO: 3406 - RNA, 19 nt, artificial
  Chemically Synthesized
auuaaagaguucacaaggu

SEQ ID NO: 3407 - RNA, 19 nt, artificial
  Chemically Synthesized
aaagucugcuuagauuggg

SEQ ID NO: 3408 - RNA, 19 nt, artificial
  Chemically Synthesized
agaaagggcauuuaaaagu

SEQ ID NO: 3409 - RNA, 19 nt, artificial
  Chemically Synthesized
ugaaaaauaaguucagcac

SEQ ID NO: 3410 - RNA, 19 nt, artificial
  Chemically Synthesized
cagcacuuaaaagauuccg

SEQ ID NO: 3411 - RNA, 19 nt, artificial
  Chemically Synthesized
ugcuuugcugucauuugac

SEQ ID NO: 3412 - RNA, 19 nt, artificial
  Chemically Synthesized
auaaagcaggcaaucacca

SEQ ID NO: 3413 - RNA, 19 nt, artificial
  Chemically Synthesized
uaaagcaggcaaucaccau

SEQ ID NO: 3414 - RNA, 19 nt, artificial
  Chemically Synthesized
aaauagacaucucugccac

SEQ ID NO: 3415 - RNA, 19 nt, artificial
  Chemically Synthesized
ccacuauacaagaaaacuc

SEQ ID NO: 3416 - RNA, 19 nt, artificial
  Chemically Synthesized
aauuucugaccaaaagacu

SEQ ID NO: 3417 - RNA, 19 nt, artificial
  Chemically Synthesized
gcagucguucauguuguau

SEQ ID NO: 3418 - RNA, 19 nt, artificial
  Chemically Synthesized
guccaaguaagagaacacc

SEQ ID NO: 3419 - RNA, 19 nt, artificial
  Chemically Synthesized
caaguaagagaacacccug

SEQ ID NO: 3420 - RNA, 19 nt, artificial
  Chemically Synthesized
ugguccgacaggcuguuuu

SEQ ID NO: 3421 - RNA, 19 nt, artificial
  Chemically Synthesized
uguuguuguuguuguugug

SEQ ID NO: 3422 - RNA, 19 nt, artificial
  Chemically Synthesized
aaaaaucaaagcacugguc

SEQ ID NO: 3423 - RNA, 19 nt, artificial
  Chemically Synthesized
acugaaggcuuucaugcug

SEQ ID NO: 3424 - RNA, 19 nt, artificial
  Chemically Synthesized
agcacuuaaaagauuccgu

SEQ ID NO: 3425 - RNA, 19 nt, artificial
  Chemically Synthesized
auuccgugaauuuguuguu

SEQ ID NO: 3426 - RNA, 19 nt, artificial
  Chemically Synthesized
cgugaauuuguuguuguug

SEQ ID NO: 3427 - RNA, 19 nt, artificial
  Chemically Synthesized
gugaauuuguuguuguugu

SEQ ID NO: 3428 - RNA, 19 nt, artificial
  Chemically Synthesized
uuguuguugugcaaagaau

SEQ ID NO: 3429 - RNA, 19 nt, artificial
  Chemically Synthesized
ucuugcucaccuucuuguu

SEQ ID NO: 3430 - RNA, 19 nt, artificial
  Chemically Synthesized
ggacugaaggcuuucaugc

SEQ ID NO: 3431 - RNA, 19 nt, artificial
  Chemically Synthesized
ucugaaauaaagcaggcaa

SEQ ID NO: 3432 - RNA, 19 nt, artificial
  Chemically Synthesized
ugacugaauacuggauccu

SEQ ID NO: 3433 - RNA, 19 nt, artificial
  Chemically Synthesized
ugaauacuggauccuucug

SEQ ID NO: 3434 - RNA, 19 nt, artificial
  Chemically Synthesized
gaauacuggauccuucugg

SEQ ID NO: 3435 - RNA, 19 nt, artificial
  Chemically Synthesized
aaaaaaggcaaagucugcu

SEQ ID NO: 3436 - RNA, 19 nt, artificial
  Chemically Synthesized
caggaugcugauauccgug

SEQ ID NO: 3437 - RNA, 19 nt, artificial
  Chemically Synthesized
gugucaaaaagguaauuuc

SEQ ID NO: 3438 - RNA, 19 nt, artificial
  Chemically Synthesized
auguuguauagcaggcuca

SEQ ID NO: 3439 - RNA, 19 nt, artificial
  Chemically Synthesized
guuguauagcaggcucauc

SEQ ID NO: 3440 - RNA, 19 nt, artificial
  Chemically Synthesized
auaucacaguccaaguaag

SEQ ID NO: 3441 - RNA, 19 nt, artificial
  Chemically Synthesized
aagagaacacccugggaag

SEQ ID NO: 3442 - RNA, 19 nt, artificial
  Chemically Synthesized
uaaguucagcacuuaaaag

SEQ ID NO: 3443 - RNA, 19 nt, artificial
  Chemically Synthesized
cagaagggaauucagaagc

SEQ ID NO: 3444 - RNA, 19 nt, artificial
  Chemically Synthesized
caggauuuccaucuugcuc

SEQ ID NO: 3445 - RNA, 19 nt, artificial
  Chemically Synthesized
aaaucaaagcacugguccu

SEQ ID NO: 3446 - RNA, 19 nt, artificial
  Chemically Synthesized
guccucugaaauaaagcag

SEQ ID NO: 3447 - RNA, 19 nt, artificial
  Chemically Synthesized
auagacaucucugccacua

SEQ ID NO: 3448 - RNA, 19 nt, artificial
  Chemically Synthesized
aagguuucacucaaauaga

SEQ ID NO: 3449 - RNA, 19 nt, artificial
  Chemically Synthesized
caaaaagguaauuucugac

SEQ ID NO: 3450 - RNA, 19 nt, artificial
  Chemically Synthesized
gauccuucugguauucacg

SEQ ID NO: 3451 - RNA, 19 nt, artificial
  Chemically Synthesized
ucugcuuagauugggcaau

SEQ ID NO: 3452 - RNA, 19 nt, artificial
  Chemically Synthesized
uccuugugauuuuaacguu

SEQ ID NO: 3453 - RNA, 19 nt, artificial
  Chemically Synthesized
auggugggaauaguauaua

SEQ ID NO: 3454 - RNA, 19 nt, artificial
  Chemically Synthesized
gugggaauaguauauaaag

SEQ ID NO: 3455 - RNA, 19 nt, artificial
  Chemically Synthesized
aauaucacaguccaaguaa

SEQ ID NO: 3456 - RNA, 19 nt, artificial
  Chemically Synthesized
aguccaaguaagagaacac

SEQ ID NO: 3457 - RNA, 19 nt, artificial
  Chemically Synthesized
ugcugauauccguguugag

SEQ ID NO: 3458 - RNA, 19 nt, artificial
  Chemically Synthesized
agguccaagauguagucga

SEQ ID NO: 3459 - RNA, 19 nt, artificial
  Chemically Synthesized
ucacgggacugaaggcuuu

SEQ ID NO: 3460 - RNA, 19 nt, artificial
  Chemically Synthesized
auguagucgaugacgugcu

SEQ ID NO: 3461 - RNA, 19 nt, artificial
  Chemically Synthesized
ugaaugcagaaauagacau

SEQ ID NO: 3462 - RNA, 19 nt, artificial
  Chemically Synthesized
cacuauacaagaaaacucu

SEQ ID NO: 3463 - RNA, 19 nt, artificial
  Chemically Synthesized
ccuucugguauucacgcuc

SEQ ID NO: 3464 - RNA, 19 nt, artificial
  Chemically Synthesized
aaaggcaaagucugcuuag

SEQ ID NO: 3465 - RNA, 19 nt, artificial
  Chemically Synthesized
aaaccuuccaacugcagaa

SEQ ID NO: 3466 - RNA, 19 nt, artificial
  Chemically Synthesized
gauuccgugaauuuguugu

SEQ ID NO: 3467 - RNA, 19 nt, artificial
  Chemically Synthesized
auuaacucagaagggaauu

SEQ ID NO: 3468 - RNA, 19 nt, artificial
  Chemically Synthesized
guccaagauguagucgaug

SEQ ID NO: 3469 - RNA, 19 nt, artificial
  Chemically Synthesized
uagucgaugacgugcugca

SEQ ID NO: 3470 - RNA, 19 nt, artificial
  Chemically Synthesized
auucaguaggcuuguguca

SEQ ID NO: 3471 - RNA, 19 nt, artificial
  Chemically Synthesized
uguuguuguugugcaaaga

SEQ ID NO: 3472 - RNA, 19 nt, artificial
  Chemically Synthesized
acaccgcuuauucagccac

SEQ ID NO: 3473 - RNA, 19 nt, artificial
  Chemically Synthesized
acaggaugcugauauccgu

SEQ ID NO: 3474 - RNA, 19 nt, artificial
  Chemically Synthesized
acaauagugggaugcgagu

SEQ ID NO: 3475 - RNA, 19 nt, artificial
  Chemically Synthesized
guucacaagguuucacuca

SEQ ID NO: 3476 - RNA, 19 nt, artificial
  Chemically Synthesized
guaauuucugaccaaaaga

SEQ ID NO: 3477 - RNA, 19 nt, artificial
  Chemically Synthesized
gugacugaauacuggaucc

SEQ ID NO: 3478 - RNA, 19 nt, artificial
  Chemically Synthesized
acacccugggaagaugauc

SEQ ID NO: 3479 - RNA, 19 nt, artificial
  Chemically Synthesized
gcacuuaaaagauuccgug

SEQ ID NO: 3480 - RNA, 19 nt, artificial
  Chemically Synthesized
acaggcuguuuuuccuaac

SEQ ID NO: 3481 - RNA, 19 nt, artificial
  Chemically Synthesized
gacaggaugcugauauccg

SEQ ID NO: 3482 - RNA, 19 nt, artificial
  Chemically Synthesized
ugcucaccuucuuguucug

SEQ ID NO: 3483 - RNA, 19 nt, artificial
  Chemically Synthesized
gacaucucugccacuauac

SEQ ID NO: 3484 - RNA, 19 nt, artificial
  Chemically Synthesized
ucugaccaaaagacuucau

SEQ ID NO: 3485 - RNA, 19 nt, artificial
  Chemically Synthesized
aagucugcuuagauugggc

SEQ ID NO: 3486 - RNA, 19 nt, artificial
  Chemically Synthesized
cauguuguauagcaggcuc

SEQ ID NO: 3487 - RNA, 19 nt, artificial
  Chemically Synthesized
aggcuguuuuuccuaacgg

SEQ ID NO: 3488 - RNA, 19 nt, artificial
  Chemically Synthesized
gacaauagugggaugcgag

SEQ ID NO: 3489 - RNA, 19 nt, artificial
  Chemically Synthesized
cucaccuucuuguucuggg

SEQ ID NO: 3490 - RNA, 19 nt, artificial
  Chemically Synthesized
agcuccuugagcuuggagu

SEQ ID NO: 3491 - RNA, 19 nt, artificial
  Chemically Synthesized
acaagguuucacucaaaua

SEQ ID NO: 3492 - RNA, 19 nt, artificial
  Chemically Synthesized
guaggcuugugucaaaaag

SEQ ID NO: 3493 - RNA, 19 nt, artificial
  Chemically Synthesized
cugaccaaaagacuucauu

SEQ ID NO: 3494 - RNA, 19 nt, artificial
  Chemically Synthesized
agcagucguucauguugua

SEQ ID NO: 3495 - RNA, 19 nt, artificial
  Chemically Synthesized
ugggcaauuccuugugauu

SEQ ID NO: 3496 - RNA, 19 nt, artificial
  Chemically Synthesized
aacugcagaaagggcauuu

SEQ ID NO: 3497 - RNA, 19 nt, artificial
  Chemically Synthesized
ccaaguaagagaacacccu

SEQ ID NO: 3498 - RNA, 19 nt, artificial
  Chemically Synthesized
cgcuuauucagccacacag

SEQ ID NO: 3499 - RNA, 19 nt, artificial
  Chemically Synthesized
cugucauuugacauuaacu

SEQ ID NO: 3500 - RNA, 19 nt, artificial
  Chemically Synthesized
aacucagaagggaauucag

SEQ ID NO: 3501 - RNA, 19 nt, artificial
  Chemically Synthesized
caauagugggaugcgaguc

SEQ ID NO: 3502 - RNA, 19 nt, artificial
  Chemically Synthesized
aauagacaucucugccacu

SEQ ID NO: 3503 - RNA, 19 nt, artificial
  Chemically Synthesized
acaucucugccacuauaca

SEQ ID NO: 3504 - RNA, 19 nt, artificial
  Chemically Synthesized
acuucauuuaagugacuga

SEQ ID NO: 3505 - RNA, 19 nt, artificial
  Chemically Synthesized
cugaaggcuuucaugcuga

SEQ ID NO: 3506 - RNA, 19 nt, artificial
  Chemically Synthesized
gugcuuugcugucauuuga

SEQ ID NO: 3507 - RNA, 19 nt, artificial
  Chemically Synthesized
ucugcagguccaagaugua

SEQ ID NO: 3508 - RNA, 19 nt, artificial
  Chemically Synthesized
gaaggcuuucaugcugacc

SEQ ID NO: 3509 - RNA, 19 nt, artificial
  Chemically Synthesized
aagauguagucgaugacgu

SEQ ID NO: 3510 - RNA, 19 nt, artificial
  Chemically Synthesized
cugguccucugaaauaaag

SEQ ID NO: 3511 - RNA, 19 nt, artificial
  Chemically Synthesized
uagacaucucugccacuau

SEQ ID NO: 3512 - RNA, 19 nt, artificial
  Chemically Synthesized
ucacaagguuucacucaaa

SEQ ID NO: 3513 - RNA, 19 nt, artificial
  Chemically Synthesized
cagaaagggcauuuaaaag

SEQ ID NO: 3514 - RNA, 19 nt, artificial
  Chemically Synthesized
cacccugggaagaugauca

SEQ ID NO: 3515 - RNA, 19 nt, artificial
  Chemically Synthesized
gaucauucuuaguuuuccu

SEQ ID NO: 3516 - RNA, 19 nt, artificial
  Chemically Synthesized
guauuuauuuggguucagu

SEQ ID NO: 3517 - RNA, 19 nt, artificial
  Chemically Synthesized
agcacugguccucugaaau

SEQ ID NO: 3518 - RNA, 19 nt, artificial
  Chemically Synthesized
uccuucugguauucacgcu

SEQ ID NO: 3519 - RNA, 19 nt, artificial
  Chemically Synthesized
agauugggcaauuccuugu

SEQ ID NO: 3520 - RNA, 19 nt, artificial
  Chemically Synthesized
aacuuguccuccuugugaa

SEQ ID NO: 3521 - RNA, 19 nt, artificial
  Chemically Synthesized
cuuguccuccuugugaaau

SEQ ID NO: 3522 - RNA, 19 nt, artificial
  Chemically Synthesized
cuccuugugaaaugguuga

SEQ ID NO: 3523 - RNA, 19 nt, artificial
  Chemically Synthesized
agaaaucaugaacaccgcu

SEQ ID NO: 3524 - RNA, 19 nt, artificial
  Chemically Synthesized
acacagugcuuugcuguca

SEQ ID NO: 3525 - RNA, 19 nt, artificial
  Chemically Synthesized
caagauguagucgaugacg

SEQ ID NO: 3526 - RNA, 19 nt, artificial
  Chemically Synthesized
ccauucaauaaacacacuu

SEQ ID NO: 3527 - RNA, 19 nt, artificial
  Chemically Synthesized
agcuuggaguagcagucgu

SEQ ID NO: 3528 - RNA, 19 nt, artificial
  Chemically Synthesized
aaaagguaauuucugacca

SEQ ID NO: 3529 - RNA, 19 nt, artificial
  Chemically Synthesized
aauacuggauccuucuggu

SEQ ID NO: 3530 - RNA, 19 nt, artificial
  Chemically Synthesized
cguucauguuguauagcag

SEQ ID NO: 3531 - RNA, 19 nt, artificial
  Chemically Synthesized
gcuuagauugggcaauucc

SEQ ID NO: 3532 - RNA, 19 nt, artificial
  Chemically Synthesized
accuuccaacugcagaaag

SEQ ID NO: 3533 - RNA, 19 nt, artificial
  Chemically Synthesized
accgcuuauucagccacac

SEQ ID NO: 3534 - RNA, 19 nt, artificial
  Chemically Synthesized
caaagcacugguccucuga

SEQ ID NO: 3535 - RNA, 19 nt, artificial
  Chemically Synthesized
aaagcacugguccucugaa

SEQ ID NO: 3536 - RNA, 19 nt, artificial
  Chemically Synthesized
caggcaaucaccauucaau

SEQ ID NO: 3537 - RNA, 19 nt, artificial
  Chemically Synthesized
gcaugaauaaguacaucau

SEQ ID NO: 3538 - RNA, 19 nt, artificial
  Chemically Synthesized
cagaaauagacaucucugc

SEQ ID NO: 3539 - RNA, 19 nt, artificial
  Chemically Synthesized
caucucugccacuauacaa

SEQ ID NO: 3540 - RNA, 19 nt, artificial
  Chemically Synthesized
cuucauuuaagugacugaa

SEQ ID NO: 3541 - RNA, 19 nt, artificial
  Chemically Synthesized
cauuuaagugacugaauac

SEQ ID NO: 3542 - RNA, 19 nt, artificial
  Chemically Synthesized
uggauccuucugguauuca

SEQ ID NO: 3543 - RNA, 19 nt, artificial
  Chemically Synthesized
gaaaaaaggcaaagucugc

SEQ ID NO: 3544 - RNA, 19 nt, artificial
  Chemically Synthesized
agaacacccugggaagaug

SEQ ID NO: 3545 - RNA, 19 nt, artificial
  Chemically Synthesized
acuuaaaagauuccgugaa

SEQ ID NO: 3546 - RNA, 19 nt, artificial
  Chemically Synthesized
cucagaagggaauucagaa

SEQ ID NO: 3547 - RNA, 19 nt, artificial
  Chemically Synthesized
auagugggaugcgagucca

SEQ ID NO: 3548 - RNA, 19 nt, artificial
  Chemically Synthesized
cuugagcuuggaguagcag

SEQ ID NO: 3549 - RNA, 19 nt, artificial
  Chemically Synthesized
ugcuuagauugggcaauuc

SEQ ID NO: 3550 - RNA, 19 nt, artificial
  Chemically Synthesized
agaaaaccuuccaacugca

SEQ ID NO: 3551 - RNA, 19 nt, artificial
  Chemically Synthesized
ugcagaaagggcauuuaaa

SEQ ID NO: 3552 - RNA, 19 nt, artificial
  Chemically Synthesized
aaucaugaacaccgcuuau

SEQ ID NO: 3553 - RNA, 19 nt, artificial
  Chemically Synthesized
ugaaggcuuucaugcugac

SEQ ID NO: 3554 - RNA, 19 nt, artificial
  Chemically Synthesized
guuuuuccuaacggaccuc

SEQ ID NO: 3555 - RNA, 19 nt, artificial
  Chemically Synthesized
gguucaguuauaacauagc

SEQ ID NO: 3556 - RNA, 19 nt, artificial
  Chemically Synthesized
uacacuuuugaaugcagaa

SEQ ID NO: 3557 - RNA, 19 nt, artificial
  Chemically Synthesized
gcagaaauagacaucucug

SEQ ID NO: 3558 - RNA, 19 nt, artificial
  Chemically Synthesized
agacaucucugccacuaua

SEQ ID NO: 3559 - RNA, 19 nt, artificial
  Chemically Synthesized
uggugggaauaguauauaa

SEQ ID NO: 3560 - RNA, 19 nt, artificial
  Chemically Synthesized
ugggaagaugaucauucuu

SEQ ID NO: 3561 - RNA, 19 nt, artificial
  Chemically Synthesized
gaaaaauaaguucagcacu

SEQ ID NO: 3562 - RNA, 19 nt, artificial
  Chemically Synthesized
cuuugcugucauuugacau

SEQ ID NO: 3563 - RNA, 19 nt, artificial
  Chemically Synthesized
gaaugcagaaauagacauc

SEQ ID NO: 3564 - RNA, 19 nt, artificial
  Chemically Synthesized
ucaguaggcuugugucaaa

SEQ ID NO: 3565 - RNA, 19 nt, artificial
  Chemically Synthesized
ccaaaagacuucauuuaag

SEQ ID NO: 3566 - RNA, 19 nt, artificial
  Chemically Synthesized
aagacuucauuuaagugac

SEQ ID NO: 3567 - RNA, 19 nt, artificial
  Chemically Synthesized
gcaaagucugcuuagauug

SEQ ID NO: 3568 - RNA, 19 nt, artificial
  Chemically Synthesized
caaagucugcuuagauugg

SEQ ID NO: 3569 - RNA, 19 nt, artificial
  Chemically Synthesized
ccuugugauuuuaacguuu

SEQ ID NO: 3570 - RNA, 19 nt, artificial
  Chemically Synthesized
cauggugggaauaguauau

SEQ ID NO: 3571 - RNA, 19 nt, artificial
  Chemically Synthesized
uguuguauagcaggcucau

SEQ ID NO: 3572 - RNA, 19 nt, artificial
  Chemically Synthesized
caugaacaccgcuuauuca

SEQ ID NO: 3573 - RNA, 19 nt, artificial
  Chemically Synthesized
gaaauagacaucucugcca

SEQ ID NO: 3574 - RNA, 19 nt, artificial
  Chemically Synthesized
cauucaguaggcuuguguc

SEQ ID NO: 3575 - RNA, 19 nt, artificial
  Chemically Synthesized
gacuucauuuaagugacug

SEQ ID NO: 3576 - RNA, 19 nt, artificial
  Chemically Synthesized
aaaaaggcaaagucugcuu

SEQ ID NO: 3577 - RNA, 19 nt, artificial
  Chemically Synthesized
aacaccgcuuauucagcca

SEQ ID NO: 3578 - RNA, 19 nt, artificial
  Chemically Synthesized
acucagaagggaauucaga

SEQ ID NO: 3579 - RNA, 19 nt, artificial
  Chemically Synthesized
auucagaagccugcaagga

SEQ ID NO: 3580 - RNA, 19 nt, artificial
  Chemically Synthesized
cagguccaagauguagucg

SEQ ID NO: 3581 - RNA, 19 nt, artificial
  Chemically Synthesized
cugcaggauuuccaucuug

SEQ ID NO: 3582 - RNA, 19 nt, artificial
  Chemically Synthesized
gggacugaaggcuuucaug

SEQ ID NO: 3583 - RNA, 19 nt, artificial
  Chemically Synthesized
ggguucaguuauaacauag

SEQ ID NO: 3584 - RNA, 19 nt, artificial
  Chemically Synthesized
cuuuugaaugcagaaauag

SEQ ID NO: 3585 - RNA, 19 nt, artificial
  Chemically Synthesized
auugggcaauuccuuguga

SEQ ID NO: 3586 - RNA, 19 nt, artificial
  Chemically Synthesized
gaaagggcauuuaaaaguc

SEQ ID NO: 3587 - RNA, 19 nt, artificial
  Chemically Synthesized
uccuugugaaaugguugaa

SEQ ID NO: 3588 - RNA, 19 nt, artificial
  Chemically Synthesized
agauuccgugaauuuguug

SEQ ID NO: 3589 - RNA, 19 nt, artificial
  Chemically Synthesized
caggcuguuuuuccuaacg

SEQ ID NO: 3590 - RNA, 19 nt, artificial
  Chemically Synthesized
agccacacagugcuuugcu

SEQ ID NO: 3591 - RNA, 19 nt, artificial
  Chemically Synthesized
gcuguuuuuccuaacggac

SEQ ID NO: 3592 - RNA, 19 nt, artificial
  Chemically Synthesized
cugcagguccaagauguag

SEQ ID NO: 3593 - RNA, 19 nt, artificial
  Chemically Synthesized
uggguucaguuauaacaua

SEQ ID NO: 3594 - RNA, 19 nt, artificial
  Chemically Synthesized
aagcacugguccucugaaa

SEQ ID NO: 3595 - RNA, 19 nt, artificial
  Chemically Synthesized
guacaucauuacacuuuug

SEQ ID NO: 3596 - RNA, 19 nt, artificial
  Chemically Synthesized
cucuaauuaaagaguucac

SEQ ID NO: 3597 - RNA, 19 nt, artificial
  Chemically Synthesized
agaguucacaagguuucac

SEQ ID NO: 3598 - RNA, 19 nt, artificial
  Chemically Synthesized
aagguaauuucugaccaaa

SEQ ID NO: 3599 - RNA, 19 nt, artificial
  Chemically Synthesized
ccaccuuugaaaaaaggca

SEQ ID NO: 3600 - RNA, 19 nt, artificial
  Chemically Synthesized
aagggcauuuaaaagucuu

SEQ ID NO: 3601 - RNA, 19 nt, artificial
  Chemically Synthesized
cgaauaucacaguccaagu

SEQ ID NO: 3602 - RNA, 19 nt, artificial
  Chemically Synthesized
cagugcuuugcugucauuu

SEQ ID NO: 3603 - RNA, 19 nt, artificial
  Chemically Synthesized
acugguccucugaaauaaa

SEQ ID NO: 3604 - RNA, 19 nt, artificial
  Chemically Synthesized
guuuagcaugaauaaguac

SEQ ID NO: 3605 - RNA, 19 nt, artificial
  Chemically Synthesized
gcuuggaguagcagucguu

SEQ ID NO: 3606 - RNA, 19 nt, artificial
  Chemically Synthesized
cuugugaaaugguugaaaa

SEQ ID NO: 3607 - RNA, 19 nt, artificial
  Chemically Synthesized
aguucagcacuuaaaagau

SEQ ID NO: 3608 - RNA, 19 nt, artificial
  Chemically Synthesized
gucauuugacauuaacuca

SEQ ID NO: 3609 - RNA, 19 nt, artificial
  Chemically Synthesized
acauuaacucagaagggaa

SEQ ID NO: 3610 - RNA, 19 nt, artificial
  Chemically Synthesized
aggaugcugauauccgugu

SEQ ID NO: 3611 - RNA, 19 nt, artificial
  Chemically Synthesized
cugacaauagugggaugcg

SEQ ID NO: 3612 - RNA, 19 nt, artificial
  Chemically Synthesized
gugcugcaggauuuccauc

SEQ ID NO: 3613 - RNA, 19 nt, artificial
  Chemically Synthesized
gcucaccuucuuguucugg

SEQ ID NO: 3614 - RNA, 19 nt, artificial
  Chemically Synthesized
aggcaaucaccauucaaua

SEQ ID NO: 3615 - RNA, 19 nt, artificial
  Chemically Synthesized
cacuuuugaaugcagaaau

SEQ ID NO: 3616 - RNA, 19 nt, artificial
  Chemically Synthesized
acuggauccuucugguauu

SEQ ID NO: 3617 - RNA, 19 nt, artificial
  Chemically Synthesized
agucugcuuagauugggca

SEQ ID NO: 3618 - RNA, 19 nt, artificial
  Chemically Synthesized
gaacaccgcuuauucagcc

SEQ ID NO: 3619 - RNA, 19 nt, artificial
  Chemically Synthesized
ccaagauguagucgaugac

SEQ ID NO: 3620 - RNA, 19 nt, artificial
  Chemically Synthesized
agauguagucgaugacgug

SEQ ID NO: 3621 - RNA, 19 nt, artificial
  Chemically Synthesized
gaugacgugcugcaggauu

SEQ ID NO: 3622 - RNA, 19 nt, artificial
  Chemically Synthesized
gaguucacaagguuucacu

SEQ ID NO: 3623 - RNA, 19 nt, artificial
  Chemically Synthesized
aaaaggcaaagucugcuua

SEQ ID NO: 3624 - RNA, 19 nt, artificial
  Chemically Synthesized
aacgaauaucacaguccaa

SEQ ID NO: 3625 - RNA, 19 nt, artificial
  Chemically Synthesized
guugaaaaauaaguucagc

SEQ ID NO: 3626 - RNA, 19 nt, artificial
  Chemically Synthesized
uauccguguugaggguggu

SEQ ID NO: 3627 - RNA, 19 nt, artificial
  Chemically Synthesized
aagaguucacaagguuuca

SEQ ID NO: 3628 - RNA, 19 nt, artificial
  Chemically Synthesized
gacugaauacuggauccuu

SEQ ID NO: 3629 - RNA, 19 nt, artificial
  Chemically Synthesized
gggcaauuccuugugauuu

SEQ ID NO: 3630 - RNA, 19 nt, artificial
  Chemically Synthesized
guugugcaaagaauaaaag

SEQ ID NO: 3631 - RNA, 19 nt, artificial
  Chemically Synthesized
auucagccacacagugcuu

SEQ ID NO: 3632 - RNA, 19 nt, artificial
  Chemically Synthesized
aagccugcaaggacaggau

SEQ ID NO: 3633 - RNA, 19 nt, artificial
  Chemically Synthesized
gaugcugauauccguguug

SEQ ID NO: 3634 - RNA, 19 nt, artificial
  Chemically Synthesized
uguagucgaugacgugcug

SEQ ID NO: 3635 - RNA, 19 nt, artificial
  Chemically Synthesized
acgggacugaaggcuuuca

SEQ ID NO: 3636 - RNA, 19 nt, artificial
  Chemically Synthesized
gaaauaaagcaggcaauca

SEQ ID NO: 3637 - RNA, 19 nt, artificial
  Chemically Synthesized
cauuacacuuuugaaugca

SEQ ID NO: 3638 - RNA, 19 nt, artificial
  Chemically Synthesized
auacuggauccuucuggua

SEQ ID NO: 3639 - RNA, 19 nt, artificial
  Chemically Synthesized
acugcagaaagggcauuua

SEQ ID NO: 3640 - RNA, 19 nt, artificial
  Chemically Synthesized
ggaagaugaucauucuuag

SEQ ID NO: 3641 - RNA, 19 nt, artificial
  Chemically Synthesized
gcugacaauagugggaugc

SEQ ID NO: 3642 - RNA, 19 nt, artificial
  Chemically Synthesized
ccaucuugcucaccuucuu

SEQ ID NO: 3643 - RNA, 19 nt, artificial
  Chemically Synthesized
cacaagguuucacucaaau

SEQ ID NO: 3644 - RNA, 19 nt, artificial
  Chemically Synthesized
gcauucaguaggcuugugu

SEQ ID NO: 3645 - RNA, 19 nt, artificial
  Chemically Synthesized
gaaaaccuuccaacugcag

SEQ ID NO: 3646 - RNA, 19 nt, artificial
  Chemically Synthesized
ccacacagugcuuugcugu

SEQ ID NO: 3647 - RNA, 19 nt, artificial
  Chemically Synthesized
cacacagugcuuugcuguc

SEQ ID NO: 3648 - RNA, 19 nt, artificial
  Chemically Synthesized
agaagggaauucagaagcc

SEQ ID NO: 3649 - RNA, 19 nt, artificial
  Chemically Synthesized
gugaugcaggcugacaaua

SEQ ID NO: 3650 - RNA, 19 nt, artificial
  Chemically Synthesized
aggcugacaauagugggau

SEQ ID NO: 3651 - RNA, 19 nt, artificial
  Chemically Synthesized
gcaaucaccauucaauaaa

SEQ ID NO: 3652 - RNA, 19 nt, artificial
  Chemically Synthesized
cacagcauucaguaggcuu

SEQ ID NO: 3653 - RNA, 19 nt, artificial
  Chemically Synthesized
agguaauuucugaccaaaa

SEQ ID NO: 3654 - RNA, 19 nt, artificial
  Chemically Synthesized
cuccaccuuugaaaaaagg

SEQ ID NO: 3655 - RNA, 19 nt, artificial
  Chemically Synthesized
cuuugaaaaaaggcaaagu

SEQ ID NO: 3656 - RNA, 19 nt, artificial
  Chemically Synthesized
guaagagaacacccuggga

SEQ ID NO: 3657 - RNA, 19 nt, artificial
  Chemically Synthesized
gaacacccugggaagauga

SEQ ID NO: 3658 - RNA, 19 nt, artificial
  Chemically Synthesized
guccgacaggcuguuuuuc

SEQ ID NO: 3659 - RNA, 19 nt, artificial
  Chemically Synthesized
cuuaaaagauuccgugaau

SEQ ID NO: 3660 - RNA, 19 nt, artificial
  Chemically Synthesized
caccgcuuauucagccaca

SEQ ID NO: 3661 - RNA, 19 nt, artificial
  Chemically Synthesized
gcugucauuugacauuaac

SEQ ID NO: 3662 - RNA, 19 nt, artificial
  Chemically Synthesized
aggacaggaugcugauauc

SEQ ID NO: 3663 - RNA, 19 nt, artificial
  Chemically Synthesized
gccacuauacaagaaaacu

SEQ ID NO: 3664 - RNA, 19 nt, artificial
  Chemically Synthesized
agggcauuuaaaagucuuu

SEQ ID NO: 3665 - RNA, 19 nt, artificial
  Chemically Synthesized
gggaagaugaucauucuua

SEQ ID NO: 3666 - RNA, 19 nt, artificial
  Chemically Synthesized
guccuccuugugaaauggu

SEQ ID NO: 3667 - RNA, 19 nt, artificial
  Chemically Synthesized
ccgcuuauucagccacaca

SEQ ID NO: 3668 - RNA, 19 nt, artificial
  Chemically Synthesized
gauuuccaucuugcucacc

SEQ ID NO: 3669 - RNA, 19 nt, artificial
  Chemically Synthesized
caaucaccauucaauaaac

SEQ ID NO: 3670 - RNA, 19 nt, artificial
  Chemically Synthesized
caguccaaguaagagaaca

SEQ ID NO: 3671 - RNA, 19 nt, artificial
  Chemically Synthesized
ggacaggaugcugauaucc

SEQ ID NO: 3672 - RNA, 19 nt, artificial
  Chemically Synthesized
gaugcaggcugacaauagu

SEQ ID NO: 3673 - RNA, 19 nt, artificial
  Chemically Synthesized
guucaguuauaacauagca

SEQ ID NO: 3674 - RNA, 19 nt, artificial
  Chemically Synthesized
accauucaauaaacacacu

SEQ ID NO: 3675 - RNA, 19 nt, artificial
  Chemically Synthesized
caccuuugaaaaaaggcaa

SEQ ID NO: 3676 - RNA, 19 nt, artificial
  Chemically Synthesized
ccuuccaacugcagaaagg

SEQ ID NO: 3677 - RNA, 19 nt, artificial
  Chemically Synthesized
acuuguccuccuugugaaa

SEQ ID NO: 3678 - RNA, 19 nt, artificial
  Chemically Synthesized
ccuugugaaaugguugaaa

SEQ ID NO: 3679 - RNA, 19 nt, artificial
  Chemically Synthesized
ccgacaggcuguuuuuccu

SEQ ID NO: 3680 - RNA, 19 nt, artificial
  Chemically Synthesized
gcagguccaagauguaguc

SEQ ID NO: 3681 - RNA, 19 nt, artificial
  Chemically Synthesized
gguccucugaaauaaagca

SEQ ID NO: 3682 - RNA, 19 nt, artificial
  Chemically Synthesized
gguuucacucaaauagaua

SEQ ID NO: 3683 - RNA, 19 nt, artificial
  Chemically Synthesized
aggcuugugucaaaaaggu

SEQ ID NO: 3684 - RNA, 19 nt, artificial
  Chemically Synthesized
gcuugugucaaaaagguaa

SEQ ID NO: 3685 - RNA, 19 nt, artificial
  Chemically Synthesized
gaccaaaagacuucauuua

SEQ ID NO: 3686 - RNA, 19 nt, artificial
  Chemically Synthesized
aggcaaagucugcuuagau

SEQ ID NO: 3687 - RNA, 19 nt, artificial
  Chemically Synthesized
acaguccaaguaagagaac

SEQ ID NO: 3688 - RNA, 19 nt, artificial
  Chemically Synthesized
aagauuccgugaauuuguu

SEQ ID NO: 3689 - RNA, 19 nt, artificial
  Chemically Synthesized
cacugguccucugaaauaa

SEQ ID NO: 3690 - RNA, 19 nt, artificial
  Chemically Synthesized
acacuuuugaaugcagaaa

SEQ ID NO: 3691 - RNA, 19 nt, artificial
  Chemically Synthesized
aaagggcauuuaaaagucu

SEQ ID NO: 3692 - RNA, 19 nt, artificial
  Chemically Synthesized
cacaguccaaguaagagaa

SEQ ID NO: 3693 - RNA, 19 nt, artificial
  Chemically Synthesized
agagaacacccugggaaga

SEQ ID NO: 3694 - RNA, 19 nt, artificial
  Chemically Synthesized
cugggaagaugaucauucu

SEQ ID NO: 3695 - RNA, 19 nt, artificial
  Chemically Synthesized
guucagcacuuaaaagauu

SEQ ID NO: 3696 - RNA, 19 nt, artificial
  Chemically Synthesized
cgugcugcaggauuuccau

SEQ ID NO: 3697 - RNA, 19 nt, artificial
  Chemically Synthesized
aguaggcuugugucaaaaa

SEQ ID NO: 3698 - RNA, 19 nt, artificial
  Chemically Synthesized
aaagguaauuucugaccaa

SEQ ID NO: 3699 - RNA, 19 nt, artificial
  Chemically Synthesized
cuggauccuucugguauuc

SEQ ID NO: 3700 - RNA, 19 nt, artificial
  Chemically Synthesized
uguuguuguuguugugcaa

SEQ ID NO: 3701 - RNA, 19 nt, artificial
  Chemically Synthesized
guuguuguugugcaaagaa

SEQ ID NO: 3702 - RNA, 19 nt, artificial
  Chemically Synthesized
ugcugucauuugacauuaa

SEQ ID NO: 3703 - RNA, 19 nt, artificial
  Chemically Synthesized
gauauccguguugagggug

SEQ ID NO: 3704 - RNA, 19 nt, artificial
  Chemically Synthesized
cuccuugagcuuggaguag

SEQ ID NO: 3705 - RNA, 19 nt, artificial
  Chemically Synthesized
aaccuuccaacugcagaaa

SEQ ID NO: 3706 - RNA, 19 nt, artificial
  Chemically Synthesized
aggguuaaguuuacaacua

SEQ ID NO: 3707 - RNA, 19 nt, artificial
  Chemically Synthesized
gacuucuuuugguuuucuu

SEQ ID NO: 3708 - RNA, 19 nt, artificial
  Chemically Synthesized
gggccauuuugaauaaaga

SEQ ID NO: 3709 - RNA, 19 nt, artificial
  Chemically Synthesized
ggaggaagccuguuugcaa

SEQ ID NO: 3710 - RNA, 19 nt, artificial
  Chemically Synthesized
ggacuucuuuugguuuucu

SEQ ID NO: 3711 - RNA, 19 nt, artificial
  Chemically Synthesized
agcaaauucuggaaguuaa

SEQ ID NO: 3712 - RNA, 19 nt, artificial
  Chemically Synthesized
gcaaauucuggaaguuaau

SEQ ID NO: 3713 - RNA, 19 nt, artificial
  Chemically Synthesized
cccacuugacuucaccaaa

SEQ ID NO: 3714 - RNA, 19 nt, artificial
  Chemically Synthesized
cuuuugguuuucuuucucu

SEQ ID NO: 3715 - RNA, 19 nt, artificial
  Chemically Synthesized
gcuugcuggacgacaugaa

SEQ ID NO: 3716 - RNA, 19 nt, artificial
  Chemically Synthesized
aagccuguuugcaauuuaa

SEQ ID NO: 3717 - RNA, 19 nt, artificial
  Chemically Synthesized
ggaaguuaaugguuuugag

SEQ ID NO: 3718 - RNA, 19 nt, artificial
  Chemically Synthesized
ggaaaaagcaaauucugga

SEQ ID NO: 3719 - RNA, 19 nt, artificial
  Chemically Synthesized
gaggaagccuguuugcaau

SEQ ID NO: 3720 - RNA, 19 nt, artificial
  Chemically Synthesized
cccugauuuaugaacucua

SEQ ID NO: 3721 - RNA, 19 nt, artificial
  Chemically Synthesized
aggagcgaaggacugugaa

SEQ ID NO: 3722 - RNA, 19 nt, artificial
  Chemically Synthesized
cggaacuugucaucuccaa

SEQ ID NO: 3723 - RNA, 19 nt, artificial
  Chemically Synthesized
cgggacuucuuuugguuuu

SEQ ID NO: 3724 - RNA, 19 nt, artificial
  Chemically Synthesized
gcgggccauuuugaauaaa

SEQ ID NO: 3725 - RNA, 19 nt, artificial
  Chemically Synthesized
cagggaagcucaaagaucu

SEQ ID NO: 3726 - RNA, 19 nt, artificial
  Chemically Synthesized
gaaaaagcaaauucuggaa

SEQ ID NO: 3727 - RNA, 19 nt, artificial
  Chemically Synthesized
ugagcuugcuggacgacau

SEQ ID NO: 3728 - RNA, 19 nt, artificial
  Chemically Synthesized
ggcgggccauuuugaauaa

SEQ ID NO: 3729 - RNA, 19 nt, artificial
  Chemically Synthesized
aauuuaagcgggcugugaa

SEQ ID NO: 3730 - RNA, 19 nt, artificial
  Chemically Synthesized
gcgggacuucuuuugguuu

SEQ ID NO: 3731 - RNA, 19 nt, artificial
  Chemically Synthesized
aggugacuuucuguaacaa

SEQ ID NO: 3732 - RNA, 19 nt, artificial
  Chemically Synthesized
gaagccuguuugcaauuua

SEQ ID NO: 3733 - RNA, 19 nt, artificial
  Chemically Synthesized
ggugacuuucuguaacaau

SEQ ID NO: 3734 - RNA, 19 nt, artificial
  Chemically Synthesized
ugaacuuguggccugaaga

SEQ ID NO: 3735 - RNA, 19 nt, artificial
  Chemically Synthesized
cugugaacuuguggccuga

SEQ ID NO: 3736 - RNA, 19 nt, artificial
  Chemically Synthesized
ccaggaaaaagcaaauucu

SEQ ID NO: 3737 - RNA, 19 nt, artificial
  Chemically Synthesized
cuuccaggcaggcucuaua

SEQ ID NO: 3738 - RNA, 19 nt, artificial
  Chemically Synthesized
cuucuuuugguuuucuuuc

SEQ ID NO: 3739 - RNA, 19 nt, artificial
  Chemically Synthesized
aguuaaugguuuugaguga

SEQ ID NO: 3740 - RNA, 19 nt, artificial
  Chemically Synthesized
agcgggacuucuuuugguu

SEQ ID NO: 3741 - RNA, 19 nt, artificial
  Chemically Synthesized
gcugccaggaaaaagcaaa

SEQ ID NO: 3742 - RNA, 19 nt, artificial
  Chemically Synthesized
ccaaaucccuuccuggaga

SEQ ID NO: 3743 - RNA, 19 nt, artificial
  Chemically Synthesized
gccagguggaaauccuaca

SEQ ID NO: 3744 - RNA, 19 nt, artificial
  Chemically Synthesized
caauuuaagcgggcuguga

SEQ ID NO: 3745 - RNA, 19 nt, artificial
  Chemically Synthesized
gaggcgggccauuuugaau

SEQ ID NO: 3746 - RNA, 19 nt, artificial
  Chemically Synthesized
cuguaacaaugcgauguau

SEQ ID NO: 3747 - RNA, 19 nt, artificial
  Chemically Synthesized
cuguugcccugauuuauga

SEQ ID NO: 3748 - RNA, 19 nt, artificial
  Chemically Synthesized
agcuuagccagguggaaau

SEQ ID NO: 3749 - RNA, 19 nt, artificial
  Chemically Synthesized
gcgcuuccucauucuuuga

SEQ ID NO: 3750 - RNA, 19 nt, artificial
  Chemically Synthesized
cgauuuuuaaacacuugug

SEQ ID NO: 3751 - RNA, 19 nt, artificial
  Chemically Synthesized
guucuguugcccugauuua

SEQ ID NO: 3752 - RNA, 19 nt, artificial
  Chemically Synthesized
gguucuguugcccugauuu

SEQ ID NO: 3753 - RNA, 19 nt, artificial
  Chemically Synthesized
ucuuuugguuuucuuucuc

SEQ ID NO: 3754 - RNA, 19 nt, artificial
  Chemically Synthesized
cuuuuuuacaggaagguga

SEQ ID NO: 3755 - RNA, 19 nt, artificial
  Chemically Synthesized
gcccacuugacuucaccaa

SEQ ID NO: 3756 - RNA, 19 nt, artificial
  Chemically Synthesized
acgacaugaaccacugcua

SEQ ID NO: 3757 - RNA, 19 nt, artificial
  Chemically Synthesized
ccaggcaggcucuauaagu

SEQ ID NO: 3758 - RNA, 19 nt, artificial
  Chemically Synthesized
cgggccauuuugaauaaag

SEQ ID NO: 3759 - RNA, 19 nt, artificial
  Chemically Synthesized
gguaucagcgcuuccucau

SEQ ID NO: 3760 - RNA, 19 nt, artificial
  Chemically Synthesized
aggcaggcucuauaaguga

SEQ ID NO: 3761 - RNA, 19 nt, artificial
  Chemically Synthesized
cuuggagaaagguucuguu

SEQ ID NO: 3762 - RNA, 19 nt, artificial
  Chemically Synthesized
cgacaugaaccacugcuac

SEQ ID NO: 3763 - RNA, 19 nt, artificial
  Chemically Synthesized
ucuggaaguuaaugguuuu

SEQ ID NO: 3764 - RNA, 19 nt, artificial
  Chemically Synthesized
ccuggagacuaaaccuggu

SEQ ID NO: 3765 - RNA, 19 nt, artificial
  Chemically Synthesized
ggccauuuugaauaaagag

SEQ ID NO: 3766 - RNA, 19 nt, artificial
  Chemically Synthesized
cuuucuguaacaaugcgau

SEQ ID NO: 3767 - RNA, 19 nt, artificial
  Chemically Synthesized
gaaguuaaugguuuugagu

SEQ ID NO: 3768 - RNA, 19 nt, artificial
  Chemically Synthesized
gcucuccaaacuaugccaa

SEQ ID NO: 3769 - RNA, 19 nt, artificial
  Chemically Synthesized
ugucaucuccaacgacaaa

SEQ ID NO: 3770 - RNA, 19 nt, artificial
  Chemically Synthesized
uagccagguggaaauccua

SEQ ID NO: 3771 - RNA, 19 nt, artificial
  Chemically Synthesized
cugccaggaaaaagcaaau

SEQ ID NO: 3772 - RNA, 19 nt, artificial
  Chemically Synthesized
cacuguagcgggacuucuu

SEQ ID NO: 3773 - RNA, 19 nt, artificial
  Chemically Synthesized
ggcagggaagcucaaagau

SEQ ID NO: 3774 - RNA, 19 nt, artificial
  Chemically Synthesized
ugugaacuuguggccugaa

SEQ ID NO: 3775 - RNA, 19 nt, artificial
  Chemically Synthesized
uguccugacaccuccagaa

SEQ ID NO: 3776 - RNA, 19 nt, artificial
  Chemically Synthesized
uugucaucuccaacgacaa

SEQ ID NO: 3777 - RNA, 19 nt, artificial
  Chemically Synthesized
caggaaaaagcaaauucug

SEQ ID NO: 3778 - RNA, 19 nt, artificial
  Chemically Synthesized
gggacuucuuuugguuuuc

SEQ ID NO: 3779 - RNA, 19 nt, artificial
  Chemically Synthesized
aggaaggugacuuucugua

SEQ ID NO: 3780 - RNA, 19 nt, artificial
  Chemically Synthesized
ggcugcucuccaaacuaug

SEQ ID NO: 3781 - RNA, 19 nt, artificial
  Chemically Synthesized
cuugcuggacgacaugaac

SEQ ID NO: 3782 - RNA, 19 nt, artificial
  Chemically Synthesized
ugcugccaggaaaaagcaa

SEQ ID NO: 3783 - RNA, 19 nt, artificial
  Chemically Synthesized
guucuaaggucucuucaga

SEQ ID NO: 3784 - RNA, 19 nt, artificial
  Chemically Synthesized
cagcgcuuccucauucuuu

SEQ ID NO: 3785 - RNA, 19 nt, artificial
  Chemically Synthesized
gacuaaaccuggugcucag

SEQ ID NO: 3786 - RNA, 19 nt, artificial
  Chemically Synthesized
ggagcuuuugccacugacu

SEQ ID NO: 3787 - RNA, 19 nt, artificial
  Chemically Synthesized
uuccaggcaggcucuauaa

SEQ ID NO: 3788 - RNA, 19 nt, artificial
  Chemically Synthesized
uguaccuuuuuuacaggaa

SEQ ID NO: 3789 - RNA, 19 nt, artificial
  Chemically Synthesized
guggcugcucuccaaacua

SEQ ID NO: 3790 - RNA, 19 nt, artificial
  Chemically Synthesized
caccaaaucccuuccugga

SEQ ID NO: 3791 - RNA, 19 nt, artificial
  Chemically Synthesized
ccggaacuugucaucucca

SEQ ID NO: 3792 - RNA, 19 nt, artificial
  Chemically Synthesized
gcgucaucgacuacauucu

SEQ ID NO: 3793 - RNA, 19 nt, artificial
  Chemically Synthesized
agcgcgucaucgacuacau

SEQ ID NO: 3794 - RNA, 19 nt, artificial
  Chemically Synthesized
ucagcuuagccagguggaa

SEQ ID NO: 3795 - RNA, 19 nt, artificial
  Chemically Synthesized
caggcaggcucuauaagug

SEQ ID NO: 3796 - RNA, 19 nt, artificial
  Chemically Synthesized
gucuucuggucuccuugga

SEQ ID NO: 3797 - RNA, 19 nt, artificial
  Chemically Synthesized
ccaaguucuaaggucucuu

SEQ ID NO: 3798 - RNA, 19 nt, artificial
  Chemically Synthesized
agcgaaggacugugaacuu

SEQ ID NO: 3799 - RNA, 19 nt, artificial
  Chemically Synthesized
aucccuuccuggagacuaa

SEQ ID NO: 3800 - RNA, 19 nt, artificial
  Chemically Synthesized
cuguagcgggacuucuuuu

SEQ ID NO: 3801 - RNA, 19 nt, artificial
  Chemically Synthesized
acuguagcgggacuucuuu

SEQ ID NO: 3802 - RNA, 19 nt, artificial
  Chemically Synthesized
gaguauauagguuuuguac

SEQ ID NO: 3803 - RNA, 19 nt, artificial
  Chemically Synthesized
cucacuccggaacuuguca

SEQ ID NO: 3804 - RNA, 19 nt, artificial
  Chemically Synthesized
acuacauucucgaccugca

SEQ ID NO: 3805 - RNA, 19 nt, artificial
  Chemically Synthesized
ggagacuaaaccuggugcu

SEQ ID NO: 3806 - RNA, 19 nt, artificial
  Chemically Synthesized
agcgcuuccucauucuuug

SEQ ID NO: 3807 - RNA, 19 nt, artificial
  Chemically Synthesized
ucuggucuccuuggagaaa

SEQ ID NO: 3808 - RNA, 19 nt, artificial
  Chemically Synthesized
caacgacaaaaggagcuuu

SEQ ID NO: 3809 - RNA, 19 nt, artificial
  Chemically Synthesized
ggcaggcucuauaagugac

SEQ ID NO: 3810 - RNA, 19 nt, artificial
  Chemically Synthesized
gcuuccucauucuuugaau

SEQ ID NO: 3811 - RNA, 19 nt, artificial
  Chemically Synthesized
guaccuuuuuuacaggaag

SEQ ID NO: 3812 - RNA, 19 nt, artificial
  Chemically Synthesized
uguugcccugauuuaugaa

SEQ ID NO: 3813 - RNA, 19 nt, artificial
  Chemically Synthesized
cuucuggucuccuuggaga

SEQ ID NO: 3814 - RNA, 19 nt, artificial
  Chemically Synthesized
aagcaaauucuggaaguua

SEQ ID NO: 3815 - RNA, 19 nt, artificial
  Chemically Synthesized
gaaauccuacagcgcguca

SEQ ID NO: 3816 - RNA, 19 nt, artificial
  Chemically Synthesized
gacaugaaccacugcuacu

SEQ ID NO: 3817 - RNA, 19 nt, artificial
  Chemically Synthesized
gguuuucuuucucuuuggg

SEQ ID NO: 3818 - RNA, 19 nt, artificial
  Chemically Synthesized
caggaaggugacuuucugu

SEQ ID NO: 3819 - RNA, 19 nt, artificial
  Chemically Synthesized
guuaaugguuuugagugau

SEQ ID NO: 3820 - RNA, 19 nt, artificial
  Chemically Synthesized
gugaacuuguggccugaag

SEQ ID NO: 3821 - RNA, 19 nt, artificial
  Chemically Synthesized
aggcgggccauuuugaaua

SEQ ID NO: 3822 - RNA, 19 nt, artificial
  Chemically Synthesized
gugcugccaggaaaaagca

SEQ ID NO: 3823 - RNA, 19 nt, artificial
  Chemically Synthesized
aaguucuaaggucucuuca

SEQ ID NO: 3824 - RNA, 19 nt, artificial
  Chemically Synthesized
cgacuacauucucgaccug

SEQ ID NO: 3825 - RNA, 19 nt, artificial
  Chemically Synthesized
gagcgaaggacugugaacu

SEQ ID NO: 3826 - RNA, 19 nt, artificial
  Chemically Synthesized
cuugucaucuccaacgaca

SEQ ID NO: 3827 - RNA, 19 nt, artificial
  Chemically Synthesized
gaauaaagaggcgugccuu

SEQ ID NO: 3828 - RNA, 19 nt, artificial
  Chemically Synthesized
agggaagcucaaagaucug

SEQ ID NO: 3829 - RNA, 19 nt, artificial
  Chemically Synthesized
ggaacuugucaucuccaac

SEQ ID NO: 3830 - RNA, 19 nt, artificial
  Chemically Synthesized
aaaagcaaauucuggaagu

SEQ ID NO: 3831 - RNA, 19 nt, artificial
  Chemically Synthesized
ugguuuucuuucucuuugg

SEQ ID NO: 3832 - RNA, 19 nt, artificial
  Chemically Synthesized
aacuugucaucuccaacga

SEQ ID NO: 3833 - RNA, 19 nt, artificial
  Chemically Synthesized
agcucacuccggaacuugu

SEQ ID NO: 3834 - RNA, 19 nt, artificial
  Chemically Synthesized
cauucucgaccugcaggua

SEQ ID NO: 3835 - RNA, 19 nt, artificial
  Chemically Synthesized
uagcgggacuucuuuuggu

SEQ ID NO: 3836 - RNA, 19 nt, artificial
  Chemically Synthesized
uggucuccuuggagaaagg

SEQ ID NO: 3837 - RNA, 19 nt, artificial
  Chemically Synthesized
uucuggucuccuuggagaa

SEQ ID NO: 3838 - RNA, 19 nt, artificial
  Chemically Synthesized
aguggcugcucuccaaacu

SEQ ID NO: 3839 - RNA, 19 nt, artificial
  Chemically Synthesized
aauucuggaaguuaauggu

SEQ ID NO: 3840 - RNA, 19 nt, artificial
  Chemically Synthesized
acaaaaggagcuuuugcca

SEQ ID NO: 3841 - RNA, 19 nt, artificial
  Chemically Synthesized
ugcuggacgacaugaacca

SEQ ID NO: 3842 - RNA, 19 nt, artificial
  Chemically Synthesized
uaaagaggcgugccuucca

SEQ ID NO: 3843 - RNA, 19 nt, artificial
  Chemically Synthesized
auuuaagcgggcugugaac

SEQ ID NO: 3844 - RNA, 19 nt, artificial
  Chemically Synthesized
cgcuuccucauucuuugaa

SEQ ID NO: 3845 - RNA, 19 nt, artificial
  Chemically Synthesized
ggaagcucaaagaucuggg

SEQ ID NO: 3846 - RNA, 19 nt, artificial
  Chemically Synthesized
guaucagcgcuuccucauu

SEQ ID NO: 3847 - RNA, 19 nt, artificial
  Chemically Synthesized
acacuuguguauaugauga

SEQ ID NO: 3848 - RNA, 19 nt, artificial
  Chemically Synthesized
acuuucuguaacaaugcga

SEQ ID NO: 3849 - RNA, 19 nt, artificial
  Chemically Synthesized
ccaacgacaaaaggagcuu

SEQ ID NO: 3850 - RNA, 19 nt, artificial
  Chemically Synthesized
ucaucgacuacauucucga

SEQ ID NO: 3851 - RNA, 19 nt, artificial
  Chemically Synthesized
uggaaauccuacagcgcgu

SEQ ID NO: 3852 - RNA, 19 nt, artificial
  Chemically Synthesized
agcuugcuggacgacauga

SEQ ID NO: 3853 - RNA, 19 nt, artificial
  Chemically Synthesized
cauuuugaauaaagaggcg

SEQ ID NO: 3854 - RNA, 19 nt, artificial
  Chemically Synthesized
aaagcaaauucuggaaguu

SEQ ID NO: 3855 - RNA, 19 nt, artificial
  Chemically Synthesized
uuuacaggaaggugacuuu

SEQ ID NO: 3856 - RNA, 19 nt, artificial
  Chemically Synthesized
gguuuuguaccuuuuuuac

SEQ ID NO: 3857 - RNA, 19 nt, artificial
  Chemically Synthesized
agguucuguugcccugauu

SEQ ID NO: 3858 - RNA, 19 nt, artificial
  Chemically Synthesized
uggaaguuaaugguuuuga

SEQ ID NO: 3859 - RNA, 19 nt, artificial
  Chemically Synthesized
ucccuuccuggagacuaaa

SEQ ID NO: 3860 - RNA, 19 nt, artificial
  Chemically Synthesized
agguggaaauccuacagcg

SEQ ID NO: 3861 - RNA, 19 nt, artificial
  Chemically Synthesized
aggaaaaagcaaauucugg

SEQ ID NO: 3862 - RNA, 19 nt, artificial
  Chemically Synthesized
gcaauuuaagcgggcugug

SEQ ID NO: 3863 - RNA, 19 nt, artificial
  Chemically Synthesized
ggaagccuguuugcaauuu

SEQ ID NO: 3864 - RNA, 19 nt, artificial
  Chemically Synthesized
cuccuuggagaaagguucu

SEQ ID NO: 3865 - RNA, 19 nt, artificial
  Chemically Synthesized
aggaagccuguuugcaauu

SEQ ID NO: 3866 - RNA, 19 nt, artificial
  Chemically Synthesized
uucuguugcccugauuuau

SEQ ID NO: 3867 - RNA, 19 nt, artificial
  Chemically Synthesized
agagcuggucuucuggucu

SEQ ID NO: 3868 - RNA, 19 nt, artificial
  Chemically Synthesized
uucuggaaguuaaugguuu

SEQ ID NO: 3869 - RNA, 19 nt, artificial
  Chemically Synthesized
aaauccuacagcgcgucau

SEQ ID NO: 3870 - RNA, 19 nt, artificial
  Chemically Synthesized
uuaaauccuugcuggcgga

SEQ ID NO: 3871 - RNA, 19 nt, artificial
  Chemically Synthesized
gaaagguucuguugcccug

SEQ ID NO: 3872 - RNA, 19 nt, artificial
  Chemically Synthesized
uaaggucucuucagagcgu

SEQ ID NO: 3873 - RNA, 19 nt, artificial
  Chemically Synthesized
aacgacaaaaggagcuuuu

SEQ ID NO: 3874 - RNA, 19 nt, artificial
  Chemically Synthesized
gucaucuccaacgacaaaa

SEQ ID NO: 3875 - RNA, 19 nt, artificial
  Chemically Synthesized
ccagguggaaauccuacag

SEQ ID NO: 3876 - RNA, 19 nt, artificial
  Chemically Synthesized
ccauuuugaauaaagaggc

SEQ ID NO: 3877 - RNA, 19 nt, artificial
  Chemically Synthesized
ucagcgcuuccucauucuu

SEQ ID NO: 3878 - RNA, 19 nt, artificial
  Chemically Synthesized
ggagaaagguucuguugcc

SEQ ID NO: 3879 - RNA, 19 nt, artificial
  Chemically Synthesized
ugcccacuugacuucacca

SEQ ID NO: 3880 - RNA, 19 nt, artificial
  Chemically Synthesized
cuacauucucgaccugcag

SEQ ID NO: 3881 - RNA, 19 nt, artificial
  Chemically Synthesized
gcagggaagcucaaagauc

SEQ ID NO: 3882 - RNA, 19 nt, artificial
  Chemically Synthesized
aaauccuugcuggcggaga

SEQ ID NO: 3883 - RNA, 19 nt, artificial
  Chemically Synthesized
guauauagguuuuguaccu

SEQ ID NO: 3884 - RNA, 19 nt, artificial
  Chemically Synthesized
aagguucuguugcccugau

SEQ ID NO: 3885 - RNA, 19 nt, artificial
  Chemically Synthesized
gacugugaacuuguggccu

SEQ ID NO: 3886 - RNA, 19 nt, artificial
  Chemically Synthesized
uugacuucaccaaaucccu

SEQ ID NO: 3887 - RNA, 19 nt, artificial
  Chemically Synthesized
ggucuccuuggagaaaggu

SEQ ID NO: 3888 - RNA, 19 nt, artificial
  Chemically Synthesized
uggucuucuggucuccuug

SEQ ID NO: 3889 - RNA, 19 nt, artificial
  Chemically Synthesized
ugcucuccaaacuaugcca

SEQ ID NO: 3890 - RNA, 19 nt, artificial
  Chemically Synthesized
uaaaccuggugcucaggag

SEQ ID NO: 3891 - RNA, 19 nt, artificial
  Chemically Synthesized
cuuccuggagacuaaaccu

SEQ ID NO: 3892 - RNA, 19 nt, artificial
  Chemically Synthesized
ucacuccggaacuugucau

SEQ ID NO: 3893 - RNA, 19 nt, artificial
  Chemically Synthesized
uugguuuucuuucucuuug

SEQ ID NO: 3894 - RNA, 19 nt, artificial
  Chemically Synthesized
gccuguuugcaauuuaagc

SEQ ID NO: 3895 - RNA, 19 nt, artificial
  Chemically Synthesized
gacuuucuguaacaaugcg

SEQ ID NO: 3896 - RNA, 19 nt, artificial
  Chemically Synthesized
aaagguucuguugcccuga

SEQ ID NO: 3897 - RNA, 19 nt, artificial
  Chemically Synthesized
caaguucuaaggucucuuc

SEQ ID NO: 3898 - RNA, 19 nt, artificial
  Chemically Synthesized
agacuaaaccuggugcuca

SEQ ID NO: 3899 - RNA, 19 nt, artificial
  Chemically Synthesized
ugacuucaccaaaucccuu

SEQ ID NO: 3900 - RNA, 19 nt, artificial
  Chemically Synthesized
aggagcuuuugccacugac

SEQ ID NO: 3901 - RNA, 19 nt, artificial
  Chemically Synthesized
aaggagcuuuugccacuga

SEQ ID NO: 3902 - RNA, 19 nt, artificial
  Chemically Synthesized
cgacaaaaggagcuuuugc

SEQ ID NO: 3903 - RNA, 19 nt, artificial
  Chemically Synthesized
uacaggaaggugacuuucu

SEQ ID NO: 3904 - RNA, 19 nt, artificial
  Chemically Synthesized
aguucuaaggucucuucag

SEQ ID NO: 3905 - RNA, 19 nt, artificial
  Chemically Synthesized
cuccggaacuugucaucuc

SEQ ID NO: 3906 - RNA, 19 nt, artificial
  Chemically Synthesized
gacgacaugaaccacugcu

SEQ ID NO: 3907 - RNA, 19 nt, artificial
  Chemically Synthesized
aaaaggagcuuuugccacu

SEQ ID NO: 3908 - RNA, 19 nt, artificial
  Chemically Synthesized
aauccuacagcgcgucauc

SEQ ID NO: 3909 - RNA, 19 nt, artificial
  Chemically Synthesized
agccuguuugcaauuuaag

SEQ ID NO: 3910 - RNA, 19 nt, artificial
  Chemically Synthesized
aucagcgcuuccucauucu

SEQ ID NO: 3911 - RNA, 19 nt, artificial
  Chemically Synthesized
uuuuuuacaggaaggugac

SEQ ID NO: 3912 - RNA, 19 nt, artificial
  Chemically Synthesized
ccuuggagaaagguucugu

SEQ ID NO: 3913 - RNA, 19 nt, artificial
  Chemically Synthesized
gcugcucuccaaacuaugc

SEQ ID NO: 3914 - RNA, 19 nt, artificial
  Chemically Synthesized
gccauuuugaauaaagagg

SEQ ID NO: 3915 - RNA, 19 nt, artificial
  Chemically Synthesized
cuggucuccuuggagaaag

SEQ ID NO: 3916 - RNA, 19 nt, artificial
  Chemically Synthesized
cuaaaccuggugcucagga

SEQ ID NO: 3917 - RNA, 19 nt, artificial
  Chemically Synthesized
caaauucuggaaguuaaug

SEQ ID NO: 3918 - RNA, 19 nt, artificial
  Chemically Synthesized
uucucgaccugcagguagu

SEQ ID NO: 3919 - RNA, 19 nt, artificial
  Chemically Synthesized
caucgacuacauucucgac

SEQ ID NO: 3920 - RNA, 19 nt, artificial
  Chemically Synthesized
gcuuagccagguggaaauc

SEQ ID NO: 3921 - RNA, 19 nt, artificial
  Chemically Synthesized
uggacgacaugaaccacug

SEQ ID NO: 3922 - RNA, 19 nt, artificial
  Chemically Synthesized
gauuuuuaaauccuugcug

SEQ ID NO: 3923 - RNA, 19 nt, artificial
  Chemically Synthesized
gucuccuuggagaaagguu

SEQ ID NO: 3924 - RNA, 19 nt, artificial
  Chemically Synthesized
cucuccaaacuaugccaag

SEQ ID NO: 3925 - RNA, 19 nt, artificial
  Chemically Synthesized
ucaucuccaacgacaaaag

SEQ ID NO: 3926 - RNA, 19 nt, artificial
  Chemically Synthesized
cacuccggaacuugucauc

SEQ ID NO: 3927 - RNA, 19 nt, artificial
  Chemically Synthesized
cgucaucgacuacauucuc

SEQ ID NO: 3928 - RNA, 19 nt, artificial
  Chemically Synthesized
ccucauucuuugaauccgc

SEQ ID NO: 3929 - RNA, 19 nt, artificial
  Chemically Synthesized
aucuccaacgacaaaagga

SEQ ID NO: 3930 - RNA, 19 nt, artificial
  Chemically Synthesized
cgcgucaucgacuacauuc

SEQ ID NO: 3931 - RNA, 19 nt, artificial
  Chemically Synthesized
guagcgggacuucuuuugg

SEQ ID NO: 3932 - RNA, 19 nt, artificial
  Chemically Synthesized
cucauucuuugaauccgcg

SEQ ID NO: 3933 - RNA, 19 nt, artificial
  Chemically Synthesized
ucuguugcccugauuuaug

SEQ ID NO: 3934 - RNA, 19 nt, artificial
  Chemically Synthesized
cccaaguucuaaggucucu

SEQ ID NO: 3935 - RNA, 19 nt, artificial
  Chemically Synthesized
ucuccaacgacaaaaggag

SEQ ID NO: 3936 - RNA, 19 nt, artificial
  Chemically Synthesized
uggagaaagguucuguugc

SEQ ID NO: 3937 - RNA, 19 nt, artificial
  Chemically Synthesized
ugaagagccagagcuagcu

SEQ ID NO: 3938 - RNA, 19 nt, artificial
  Chemically Synthesized
ucgacuacauucucgaccu

SEQ ID NO: 3939 - RNA, 19 nt, artificial
  Chemically Synthesized
uuagccagguggaaauccu

SEQ ID NO: 3940 - RNA, 19 nt, artificial
  Chemically Synthesized
aauaaagaggcgugccuuc

SEQ ID NO: 3941 - RNA, 19 nt, artificial
  Chemically Synthesized
ugaauaaagaggcgugccu

SEQ ID NO: 3942 - RNA, 19 nt, artificial
  Chemically Synthesized
gggaagcucaaagaucugg

SEQ ID NO: 3943 - RNA, 19 nt, artificial
  Chemically Synthesized
ugacuuucuguaacaaugc

SEQ ID NO: 3944 - RNA, 19 nt, artificial
  Chemically Synthesized
acugugaacuuguggccug

SEQ ID NO: 3945 - RNA, 19 nt, artificial
  Chemically Synthesized
cuggacgacaugaaccacu

SEQ ID NO: 3946 - RNA, 19 nt, artificial
  Chemically Synthesized
auucuggaaguuaaugguu

SEQ ID NO: 3947 - RNA, 19 nt, artificial
  Chemically Synthesized
caaaucccuuccuggagac

SEQ ID NO: 3948 - RNA, 19 nt, artificial
  Chemically Synthesized
caaaaggagcuuuugccac

SEQ ID NO: 3949 - RNA, 19 nt, artificial
  Chemically Synthesized
cagguggaaauccuacagc

SEQ ID NO: 3950 - RNA, 19 nt, artificial
  Chemically Synthesized
guuugcaauuuaagcgggc

SEQ ID NO: 3951 - RNA, 19 nt, artificial
  Chemically Synthesized
agccagguggaaauccuac

SEQ ID NO: 3952 - RNA, 19 nt, artificial
  Chemically Synthesized
aaucccuuccuggagacua

SEQ ID NO: 3953 - RNA, 19 nt, artificial
  Chemically Synthesized
uguagcgggacuucuuuug

SEQ ID NO: 3954 - RNA, 19 nt, artificial
  Chemically Synthesized
agaaagguucuguugcccu

SEQ ID NO: 3955 - RNA, 19 nt, artificial
  Chemically Synthesized
ucuccaaacuaugccaagg

SEQ ID NO: 3956 - RNA, 19 nt, artificial
  Chemically Synthesized
aggacugugaacuuguggc

SEQ ID NO: 3957 - RNA, 19 nt, artificial
  Chemically Synthesized
acuugucaucuccaacgac

SEQ ID NO: 3958 - RNA, 19 nt, artificial
  Chemically Synthesized
cauucuuugaauccgcggc

SEQ ID NO: 3959 - RNA, 19 nt, artificial
  Chemically Synthesized
uuguaccuuuuuuacagga

SEQ ID NO: 3960 - RNA, 19 nt, artificial
  Chemically Synthesized
aaguuaaugguuuugagug

SEQ ID NO: 3961 - RNA, 19 nt, artificial
  Chemically Synthesized
ucaccaaaucccuuccugg

SEQ ID NO: 3962 - RNA, 19 nt, artificial
  Chemically Synthesized
caucuccaacgacaaaagg

SEQ ID NO: 3963 - RNA, 19 nt, artificial
  Chemically Synthesized
acauucucgaccugcaggu

SEQ ID NO: 3964 - RNA, 19 nt, artificial
  Chemically Synthesized
ucacuguagcgggacuucu

SEQ ID NO: 3965 - RNA, 19 nt, artificial
  Chemically Synthesized
uuucuguaacaaugcgaug

SEQ ID NO: 3966 - RNA, 19 nt, artificial
  Chemically Synthesized
ucuucuggucuccuuggag

SEQ ID NO: 3967 - RNA, 19 nt, artificial
  Chemically Synthesized
acuccggaacuugucaucu

SEQ ID NO: 3968 - RNA, 19 nt, artificial
  Chemically Synthesized
gccaggaaaaagcaaauuc

SEQ ID NO: 3969 - RNA, 19 nt, artificial
  Chemically Synthesized
uuuugaauaaagaggcgug

SEQ ID NO: 3970 - RNA, 19 nt, artificial
  Chemically Synthesized
cuuccucauucuuugaauc

SEQ ID NO: 3971 - RNA, 19 nt, artificial
  Chemically Synthesized
aacacuuguguauaugaug

SEQ ID NO: 3972 - RNA, 19 nt, artificial
  Chemically Synthesized
uuuuuacaggaaggugacu

SEQ ID NO: 3973 - RNA, 19 nt, artificial
  Chemically Synthesized
ccuuuuuuacaggaaggug

SEQ ID NO: 3974 - RNA, 19 nt, artificial
  Chemically Synthesized
gcccugauuuaugaacucu

SEQ ID NO: 3975 - RNA, 19 nt, artificial
  Chemically Synthesized
cuggagacuaaaccuggug

SEQ ID NO: 3976 - RNA, 19 nt, artificial
  Chemically Synthesized
ccuuccuggagacuaaacc

SEQ ID NO: 3977 - RNA, 19 nt, artificial
  Chemically Synthesized
cuucaccaaaucccuuccu

SEQ ID NO: 3978 - RNA, 19 nt, artificial
  Chemically Synthesized
acgacaaaaggagcuuuug

SEQ ID NO: 3979 - RNA, 19 nt, artificial
  Chemically Synthesized
cuccaacgacaaaaggagc

SEQ ID NO: 3980 - RNA, 19 nt, artificial
  Chemically Synthesized
cuguuugcaauuuaagcgg

SEQ ID NO: 3981 - RNA, 19 nt, artificial
  Chemically Synthesized
uaccuuuuuuacaggaagg

SEQ ID NO: 3982 - RNA, 19 nt, artificial
  Chemically Synthesized
uuggagaaagguucuguug

SEQ ID NO: 3983 - RNA, 19 nt, artificial
  Chemically Synthesized
cuggaaguuaaugguuuug

SEQ ID NO: 3984 - RNA, 19 nt, artificial
  Chemically Synthesized
cuaaggucucuucagagcg

SEQ ID NO: 3985 - RNA, 19 nt, artificial
  Chemically Synthesized
aagagccagagcuagcucu

SEQ ID NO: 3986 - RNA, 19 nt, artificial
  Chemically Synthesized
aaggacugugaacuugugg

SEQ ID NO: 3987 - RNA, 19 nt, artificial
  Chemically Synthesized
uccuggagacuaaaccugg

SEQ ID NO: 3988 - RNA, 19 nt, artificial
  Chemically Synthesized
aaaaagcaaauucuggaag

SEQ ID NO: 3989 - RNA, 19 nt, artificial
  Chemically Synthesized
acaugaaccacugcuacuc

SEQ ID NO: 3990 - RNA, 19 nt, artificial
  Chemically Synthesized
gcaggcucuauaagugacc

SEQ ID NO: 3991 - RNA, 19 nt, artificial
  Chemically Synthesized
auucuuugaauccgcggcu

SEQ ID NO: 3992 - RNA, 19 nt, artificial
  Chemically Synthesized
gugauuuuuaaauccuugc

SEQ ID NO: 3993 - RNA, 19 nt, artificial
  Chemically Synthesized
ugcccugauuuaugaacuc

SEQ ID NO: 3994 - RNA, 19 nt, artificial
  Chemically Synthesized
gacaaaaggagcuuuugcc

SEQ ID NO: 3995 - RNA, 19 nt, artificial
  Chemically Synthesized
ugccaggaaaaagcaaauu

SEQ ID NO: 3996 - RNA, 19 nt, artificial
  Chemically Synthesized
gaacuugucaucuccaacg

SEQ ID NO: 3997 - RNA, 19 nt, artificial
  Chemically Synthesized
uguuugcaauuuaagcggg

SEQ ID NO: 3998 - RNA, 19 nt, artificial
  Chemically Synthesized
ucuccuuggagaaagguuc

SEQ ID NO: 3999 - RNA, 19 nt, artificial
  Chemically Synthesized
aaauucuggaaguuaaugg

SEQ ID NO: 4000 - RNA, 19 nt, artificial
  Chemically Synthesized
accaaaucccuuccuggag

SEQ ID NO: 4001 - RNA, 19 nt, artificial
  Chemically Synthesized
ugcaauuuaagcgggcugu

SEQ ID NO: 4002 - RNA, 19 nt, artificial
  Chemically Synthesized
ucauucuuugaauccgcgg

SEQ ID NO: 4003 - RNA, 19 nt, artificial
  Chemically Synthesized
uucuaaggucucuucagag

SEQ ID NO: 4004 - RNA, 19 nt, artificial
  Chemically Synthesized
cccuuccuggagacuaaac

SEQ ID NO: 4005 - RNA, 19 nt, artificial
  Chemically Synthesized
uccggaacuugucaucucc

SEQ ID NO: 4006 - RNA, 19 nt, artificial
  Chemically Synthesized
uuugcaauuuaagcgggcu

SEQ ID NO: 4007 - RNA, 19 nt, artificial
  Chemically Synthesized
gagcuuuugccacugacuc

SEQ ID NO: 4008 - RNA, 19 nt, artificial
  Chemically Synthesized
caugaaccacugcuacucc

SEQ ID NO: 4009 - RNA, 19 nt, artificial
  Chemically Synthesized
caggcucuauaagugaccg

SEQ ID NO: 4010 - RNA, 19 nt, artificial
  Chemically Synthesized
ccuguuugcaauuuaagcg

SEQ ID NO: 4011 - RNA, 19 nt, artificial
  Chemically Synthesized
uugcccugauuuaugaacu

SEQ ID NO: 4012 - RNA, 19 nt, artificial
  Chemically Synthesized
gagacuaaaccuggugcuc

SEQ ID NO: 4013 - RNA, 19 nt, artificial
  Chemically Synthesized
uucuguaacaaugcgaugu

SEQ ID NO: 4014 - RNA, 19 nt, artificial
  Chemically Synthesized
aaggucucuucagagcgug

SEQ ID NO: 4015 - RNA, 19 nt, artificial
  Chemically Synthesized
aaaggagcuuuugccacug

SEQ ID NO: 4016 - RNA, 19 nt, artificial
  Chemically Synthesized
gacuacauucucgaccugc

SEQ ID NO: 4017 - RNA, 19 nt, artificial
  Chemically Synthesized
gagaaagguucuguugccc

SEQ ID NO: 4018 - RNA, 19 nt, artificial
  Chemically Synthesized
uucaccaaaucccuuccug

SEQ ID NO: 4019 - RNA, 19 nt, artificial
  Chemically Synthesized
acuucaccaaaucccuucc

SEQ ID NO: 4020 - RNA, 19 nt, artificial
  Chemically Synthesized
auuuuuaaauccuugcugg

SEQ ID NO: 4021 - RNA, 19 nt, artificial
  Chemically Synthesized
cuugacuucaccaaauccc

SEQ ID NO: 4022 - RNA, 19 nt, artificial
  Chemically Synthesized
auuuugaauaaagaggcgu

SEQ ID NO: 4023 - RNA, 19 nt, artificial
  Chemically Synthesized
uccucauucuuugaauccg

SEQ ID NO: 4024 - RNA, 19 nt, artificial
  Chemically Synthesized
uuacaggaaggugacuuuc

SEQ ID NO: 4025 - RNA, 19 nt, artificial
  Chemically Synthesized
accuuuuuuacaggaaggu

SEQ ID NO: 4026 - RNA, 19 nt, artificial
  Chemically Synthesized
uacauucucgaccugcagg

SEQ ID NO: 4027 - RNA, 19 nt, artificial
  Chemically Synthesized
uuuuacaggaaggugacuu

SEQ ID NO: 4028 - RNA, 19 nt, artificial
  Chemically Synthesized
aguauauagguuuuguacc

SEQ ID NO: 4029 - RNA, 19 nt, artificial
  Chemically Synthesized
uccaaacuaugccaaggcg

SEQ ID NO: 4030 - RNA, 19 nt, artificial
  Chemically Synthesized
gacuucaccaaaucccuuc

SEQ ID NO: 4031 - RNA, 19 nt, artificial
  Chemically Synthesized
acuugacuucaccaaaucc

SEQ ID NO: 4032 - RNA, 19 nt, artificial
  Chemically Synthesized
guugcccugauuuaugaac

SEQ ID NO: 4033 - RNA, 19 nt, artificial
  Chemically Synthesized
agcuuuugccacugacucg

SEQ ID NO: 4034 - RNA, 19 nt, artificial
  Chemically Synthesized
uugcuggacgacaugaacc

SEQ ID NO: 4035 - RNA, 19 nt, artificial
  Chemically Synthesized
uuugaauaaagaggcgugc

SEQ ID NO: 4036 - RNA, 19 nt, artificial
  Chemically Synthesized
ucuaaggucucuucagagc

SEQ ID NO: 4037 - RNA, 19 nt, artificial
  Chemically Synthesized
uugcaauuuaagcgggcug

SEQ ID NO: 4038 - RNA, 19 nt, artificial
  Chemically Synthesized
gucaucgacuacauucucg

SEQ ID NO: 4039 - RNA, 19 nt, artificial
  Chemically Synthesized
cugcucuccaaacuaugcc

SEQ ID NO: 4040 - RNA, 19 nt, artificial
  Chemically Synthesized
acuaaaccuggugcucagg

SEQ ID NO: 4041 - RNA, 19 nt, artificial
  Chemically Synthesized
uggagacuaaaccuggugc

SEQ ID NO: 4042 - RNA, 19 nt, artificial
  Chemically Synthesized
aaaucccuuccuggagacu

SEQ ID NO: 4043 - RNA, 19 nt, artificial
  Chemically Synthesized
uccaacgacaaaaggagcu

SEQ ID NO: 4044 - RNA, 19 nt, artificial
  Chemically Synthesized
uaucagcgcuuccucauuc

SEQ ID NO: 4045 - RNA, 19 nt, artificial
  Chemically Synthesized
uuuaaauccuugcuggcgg

SEQ ID NO: 4046 - RNA, 19 nt, artificial
  Chemically Synthesized
auucucgaccugcagguag

SEQ ID NO: 4047 - RNA, 19 nt, artificial
  Chemically Synthesized
cuccaaacuaugccaaggc

SEQ ID NO: 4048 - RNA, 19 nt, artificial
  Chemically Synthesized
uuuguaccuuuuuuacagg

SEQ ID NO: 4049 - RNA, 19 nt, artificial
  Chemically Synthesized
uuccuggagacuaaaccug

SEQ ID NO: 4050 - RNA, 19 nt, artificial
  Chemically Synthesized
augaaccacugcuacuccc

SEQ ID NO: 4051 - RNA, 19 nt, artificial
  Chemically Synthesized
uuuuuaaauccuugcuggc

SEQ ID NO: 4052 - RNA, 19 nt, artificial
  Chemically Synthesized
aggcucuauaagugaccgc

SEQ ID NO: 4053 - RNA, 19 nt, artificial
  Chemically Synthesized
aacuuguggccugaagagc

SEQ ID NO: 4054 - RNA, 19 nt, artificial
  Chemically Synthesized
uuuaagcgggcugugaacg

SEQ ID NO: 4055 - RNA, 19 nt, artificial
  Chemically Synthesized
uccuuggagaaagguucug

SEQ ID NO: 4056 - RNA, 19 nt, artificial
  Chemically Synthesized
cuuagccagguggaaaucc

SEQ ID NO: 4057 - RNA, 19 nt, artificial
  Chemically Synthesized
uucuuugaauccgcggcuc

SEQ ID NO: 4058 - RNA, 19 nt, artificial
  Chemically Synthesized
uaaauccuugcuggcggag

SEQ ID NO: 4059 - RNA, 19 nt, artificial
  Chemically Synthesized
uuuuaaauccuugcuggcg

SEQ ID NO: 4060 - RNA, 19 nt, artificial
  Chemically Synthesized
auaaagaggcgugccuucc

SEQ ID NO: 4061 - RNA, 19 nt, artificial
  Chemically Synthesized
uugaauaaagaggcgugcc

SEQ ID NO: 4062 - RNA, 19 nt, artificial
  Chemically Synthesized
aucgacuacauucucgacc

SEQ ID NO: 4063 - RNA, 19 nt, artificial
  Chemically Synthesized
uuccucauucuuugaaucc

SEQ ID NO: 4064 - RNA, 19 nt, artificial
  Chemically Synthesized
aagaaaaccaaaagaaguc

SEQ ID NO: 4065 - RNA, 19 nt, artificial
  Chemically Synthesized
ucuuuauucaaaauggccc

SEQ ID NO: 4066 - RNA, 19 nt, artificial
  Chemically Synthesized
uugcaaacaggcuuccucc

SEQ ID NO: 4067 - RNA, 19 nt, artificial
  Chemically Synthesized
agaaaaccaaaagaagucc

SEQ ID NO: 4068 - RNA, 19 nt, artificial
  Chemically Synthesized
uuaacuuccagaauuugcu

SEQ ID NO: 4069 - RNA, 19 nt, artificial
  Chemically Synthesized
auuaacuuccagaauuugc

SEQ ID NO: 4070 - RNA, 19 nt, artificial
  Chemically Synthesized
uuuggugaagucaaguggg

SEQ ID NO: 4071 - RNA, 19 nt, artificial
  Chemically Synthesized
agagaaagaaaaccaaaag

SEQ ID NO: 4072 - RNA, 19 nt, artificial
  Chemically Synthesized
uucaugucguccagcaagc

SEQ ID NO: 4073 - RNA, 19 nt, artificial
  Chemically Synthesized
uuaaauugcaaacaggcuu

SEQ ID NO: 4074 - RNA, 19 nt, artificial
  Chemically Synthesized
cucaaaaccauuaacuucc

SEQ ID NO: 4075 - RNA, 19 nt, artificial
  Chemically Synthesized
uccagaauuugcuuuuucc

SEQ ID NO: 4076 - RNA, 19 nt, artificial
  Chemically Synthesized
auugcaaacaggcuuccuc

SEQ ID NO: 4077 - RNA, 19 nt, artificial
  Chemically Synthesized
uagaguucauaaaucaggg

SEQ ID NO: 4078 - RNA, 19 nt, artificial
  Chemically Synthesized
uucacaguccuucgcuccu

SEQ ID NO: 4079 - RNA, 19 nt, artificial
  Chemically Synthesized
uuggagaugacaaguuccg

SEQ ID NO: 4080 - RNA, 19 nt, artificial
  Chemically Synthesized
aaaaccaaaagaagucccg

SEQ ID NO: 4081 - RNA, 19 nt, artificial
  Chemically Synthesized
uuuauucaaaauggcccgc

SEQ ID NO: 4082 - RNA, 19 nt, artificial
  Chemically Synthesized
agaucuuugagcuucccug

SEQ ID NO: 4083 - RNA, 19 nt, artificial
  Chemically Synthesized
uuccagaauuugcuuuuuc

SEQ ID NO: 4084 - RNA, 19 nt, artificial
  Chemically Synthesized
augucguccagcaagcuca

SEQ ID NO: 4085 - RNA, 19 nt, artificial
  Chemically Synthesized
uuauucaaaauggcccgcc

SEQ ID NO: 4086 - RNA, 19 nt, artificial
  Chemically Synthesized
uucacagcccgcuuaaauu

SEQ ID NO: 4087 - RNA, 19 nt, artificial
  Chemically Synthesized
aaaccaaaagaagucccgc

SEQ ID NO: 4088 - RNA, 19 nt, artificial
  Chemically Synthesized
uuguuacagaaagucaccu

SEQ ID NO: 4089 - RNA, 19 nt, artificial
  Chemically Synthesized
uaaauugcaaacaggcuuc

SEQ ID NO: 4090 - RNA, 19 nt, artificial
  Chemically Synthesized
auuguuacagaaagucacc

SEQ ID NO: 4091 - RNA, 19 nt, artificial
  Chemically Synthesized
ucuucaggccacaaguuca

SEQ ID NO: 4092 - RNA, 19 nt, artificial
  Chemically Synthesized
ucaggccacaaguucacag

SEQ ID NO: 4093 - RNA, 19 nt, artificial
  Chemically Synthesized
agaauuugcuuuuuccugg

SEQ ID NO: 4094 - RNA, 19 nt, artificial
  Chemically Synthesized
uauagagccugccuggaag

SEQ ID NO: 4095 - RNA, 19 nt, artificial
  Chemically Synthesized
gaaagaaaaccaaaagaag

SEQ ID NO: 4096 - RNA, 19 nt, artificial
  Chemically Synthesized
ucacucaaaaccauuaacu

SEQ ID NO: 4097 - RNA, 19 nt, artificial
  Chemically Synthesized
aaccaaaagaagucccgcu

SEQ ID NO: 4098 - RNA, 19 nt, artificial
  Chemically Synthesized
uuugcuuuuuccuggcagc

SEQ ID NO: 4099 - RNA, 19 nt, artificial
  Chemically Synthesized
ucuccaggaagggauuugg

SEQ ID NO: 4100 - RNA, 19 nt, artificial
  Chemically Synthesized
uguaggauuuccaccuggc

SEQ ID NO: 4101 - RNA, 19 nt, artificial
  Chemically Synthesized
ucacagcccgcuuaaauug

SEQ ID NO: 4102 - RNA, 19 nt, artificial
  Chemically Synthesized
auucaaaauggcccgccuc

SEQ ID NO: 4103 - RNA, 19 nt, artificial
  Chemically Synthesized
auacaucgcauuguuacag

SEQ ID NO: 4104 - RNA, 19 nt, artificial
  Chemically Synthesized
ucauaaaucagggcaacag

SEQ ID NO: 4105 - RNA, 19 nt, artificial
  Chemically Synthesized
auuuccaccuggcuaagcu

SEQ ID NO: 4106 - RNA, 19 nt, artificial
  Chemically Synthesized
ucaaagaaugaggaagcgc

SEQ ID NO: 4107 - RNA, 19 nt, artificial
  Chemically Synthesized
cacaaguguuuaaaaaucg

SEQ ID NO: 4108 - RNA, 19 nt, artificial
  Chemically Synthesized
uaaaucagggcaacagaac

SEQ ID NO: 4109 - RNA, 19 nt, artificial
  Chemically Synthesized
aaaucagggcaacagaacc

SEQ ID NO: 4110 - RNA, 19 nt, artificial
  Chemically Synthesized
gagaaagaaaaccaaaaga

SEQ ID NO: 4111 - RNA, 19 nt, artificial
  Chemically Synthesized
ucaccuuccuguaaaaaag

SEQ ID NO: 4112 - RNA, 19 nt, artificial
  Chemically Synthesized
uuggugaagucaagugggc

SEQ ID NO: 4113 - RNA, 19 nt, artificial
  Chemically Synthesized
uagcagugguucaugucgu

SEQ ID NO: 4114 - RNA, 19 nt, artificial
  Chemically Synthesized
acuuauagagccugccugg

SEQ ID NO: 4115 - RNA, 19 nt, artificial
  Chemically Synthesized
cuuuauucaaaauggcccg

SEQ ID NO: 4116 - RNA, 19 nt, artificial
  Chemically Synthesized
augaggaagcgcugauacc

SEQ ID NO: 4117 - RNA, 19 nt, artificial
  Chemically Synthesized
ucacuuauagagccugccu

SEQ ID NO: 4118 - RNA, 19 nt, artificial
  Chemically Synthesized
aacagaaccuuucuccaag

SEQ ID NO: 4119 - RNA, 19 nt, artificial
  Chemically Synthesized
guagcagugguucaugucg

SEQ ID NO: 4120 - RNA, 19 nt, artificial
  Chemically Synthesized
aaaaccauuaacuuccaga

SEQ ID NO: 4121 - RNA, 19 nt, artificial
  Chemically Synthesized
accagguuuagucuccagg

SEQ ID NO: 4122 - RNA, 19 nt, artificial
  Chemically Synthesized
cucuuuauucaaaauggcc

SEQ ID NO: 4123 - RNA, 19 nt, artificial
  Chemically Synthesized
aucgcauuguuacagaaag

SEQ ID NO: 4124 - RNA, 19 nt, artificial
  Chemically Synthesized
acucaaaaccauuaacuuc

SEQ ID NO: 4125 - RNA, 19 nt, artificial
  Chemically Synthesized
uuggcauaguuuggagagc

SEQ ID NO: 4126 - RNA, 19 nt, artificial
  Chemically Synthesized
uuugucguuggagaugaca

SEQ ID NO: 4127 - RNA, 19 nt, artificial
  Chemically Synthesized
uaggauuuccaccuggcua

SEQ ID NO: 4128 - RNA, 19 nt, artificial
  Chemically Synthesized
auuugcuuuuuccuggcag

SEQ ID NO: 4129 - RNA, 19 nt, artificial
  Chemically Synthesized
aagaagucccgcuacagug

SEQ ID NO: 4130 - RNA, 19 nt, artificial
  Chemically Synthesized
aucuuugagcuucccugcc

SEQ ID NO: 4131 - RNA, 19 nt, artificial
  Chemically Synthesized
uucaggccacaaguucaca

SEQ ID NO: 4132 - RNA, 19 nt, artificial
  Chemically Synthesized
uucuggaggugucaggaca

SEQ ID NO: 4133 - RNA, 19 nt, artificial
  Chemically Synthesized
uugucguuggagaugacaa

SEQ ID NO: 4134 - RNA, 19 nt, artificial
  Chemically Synthesized
cagaauuugcuuuuuccug

SEQ ID NO: 4135 - RNA, 19 nt, artificial
  Chemically Synthesized
gaaaaccaaaagaaguccc

SEQ ID NO: 4136 - RNA, 19 nt, artificial
  Chemically Synthesized
uacagaaagucaccuuccu

SEQ ID NO: 4137 - RNA, 19 nt, artificial
  Chemically Synthesized
cauaguuuggagagcagcc

SEQ ID NO: 4138 - RNA, 19 nt, artificial
  Chemically Synthesized
guucaugucguccagcaag

SEQ ID NO: 4139 - RNA, 19 nt, artificial
  Chemically Synthesized
uugcuuuuuccuggcagca

SEQ ID NO: 4140 - RNA, 19 nt, artificial
  Chemically Synthesized
ucugaagagaccuuagaac

SEQ ID NO: 4141 - RNA, 19 nt, artificial
  Chemically Synthesized
aaagaaugaggaagcgcug

SEQ ID NO: 4142 - RNA, 19 nt, artificial
  Chemically Synthesized
cugagcaccagguuuaguc

SEQ ID NO: 4143 - RNA, 19 nt, artificial
  Chemically Synthesized
agucaguggcaaaagcucc

SEQ ID NO: 4144 - RNA, 19 nt, artificial
  Chemically Synthesized
uuauagagccugccuggaa

SEQ ID NO: 4145 - RNA, 19 nt, artificial
  Chemically Synthesized
uuccuguaaaaaagguaca

SEQ ID NO: 4146 - RNA, 19 nt, artificial
  Chemically Synthesized
uaguuuggagagcagccac

SEQ ID NO: 4147 - RNA, 19 nt, artificial
  Chemically Synthesized
uccaggaagggauuuggug

SEQ ID NO: 4148 - RNA, 19 nt, artificial
  Chemically Synthesized
uggagaugacaaguuccgg

SEQ ID NO: 4149 - RNA, 19 nt, artificial
  Chemically Synthesized
agaauguagucgaugacgc

SEQ ID NO: 4150 - RNA, 19 nt, artificial
  Chemically Synthesized
auguagucgaugacgcgcu

SEQ ID NO: 4151 - RNA, 19 nt, artificial
  Chemically Synthesized
uuccaccuggcuaagcuga

SEQ ID NO: 4152 - RNA, 19 nt, artificial
  Chemically Synthesized
cacuuauagagccugccug

SEQ ID NO: 4153 - RNA, 19 nt, artificial
  Chemically Synthesized
uccaaggagaccagaagac

SEQ ID NO: 4154 - RNA, 19 nt, artificial
  Chemically Synthesized
aagagaccuuagaacuugg

SEQ ID NO: 4155 - RNA, 19 nt, artificial
  Chemically Synthesized
aaguucacaguccuucgcu

SEQ ID NO: 4156 - RNA, 19 nt, artificial
  Chemically Synthesized
uuagucuccaggaagggau

SEQ ID NO: 4157 - RNA, 19 nt, artificial
  Chemically Synthesized
aaaagaagucccgcuacag

SEQ ID NO: 4158 - RNA, 19 nt, artificial
  Chemically Synthesized
aaagaagucccgcuacagu

SEQ ID NO: 4159 - RNA, 19 nt, artificial
  Chemically Synthesized
guacaaaaccuauauacuc

SEQ ID NO: 4160 - RNA, 19 nt, artificial
  Chemically Synthesized
ugacaaguuccggagugag

SEQ ID NO: 4161 - RNA, 19 nt, artificial
  Chemically Synthesized
ugcaggucgagaauguagu

SEQ ID NO: 4162 - RNA, 19 nt, artificial
  Chemically Synthesized
agcaccagguuuagucucc

SEQ ID NO: 4163 - RNA, 19 nt, artificial
  Chemically Synthesized
caaagaaugaggaagcgcu

SEQ ID NO: 4164 - RNA, 19 nt, artificial
  Chemically Synthesized
uuucuccaaggagaccaga

SEQ ID NO: 4165 - RNA, 19 nt, artificial
  Chemically Synthesized
aaagcuccuuuugucguug

SEQ ID NO: 4166 - RNA, 19 nt, artificial
  Chemically Synthesized
gucacuuauagagccugcc

SEQ ID NO: 4167 - RNA, 19 nt, artificial
  Chemically Synthesized
auucaaagaaugaggaagc

SEQ ID NO: 4168 - RNA, 19 nt, artificial
  Chemically Synthesized
cuuccuguaaaaaagguac

SEQ ID NO: 4169 - RNA, 19 nt, artificial
  Chemically Synthesized
uucauaaaucagggcaaca

SEQ ID NO: 4170 - RNA, 19 nt, artificial
  Chemically Synthesized
ucuccaaggagaccagaag

SEQ ID NO: 4171 - RNA, 19 nt, artificial
  Chemically Synthesized
uaacuuccagaauuugcuu

SEQ ID NO: 4172 - RNA, 19 nt, artificial
  Chemically Synthesized
ugacgcgcuguaggauuuc

SEQ ID NO: 4173 - RNA, 19 nt, artificial
  Chemically Synthesized
aguagcagugguucauguc

SEQ ID NO: 4174 - RNA, 19 nt, artificial
  Chemically Synthesized
cccaaagagaaagaaaacc

SEQ ID NO: 4175 - RNA, 19 nt, artificial
  Chemically Synthesized
acagaaagucaccuuccug

SEQ ID NO: 4176 - RNA, 19 nt, artificial
  Chemically Synthesized
aucacucaaaaccauuaac

SEQ ID NO: 4177 - RNA, 19 nt, artificial
  Chemically Synthesized
cuucaggccacaaguucac

SEQ ID NO: 4178 - RNA, 19 nt, artificial
  Chemically Synthesized
uauucaaaauggcccgccu

SEQ ID NO: 4179 - RNA, 19 nt, artificial
  Chemically Synthesized
ugcuuuuuccuggcagcac

SEQ ID NO: 4180 - RNA, 19 nt, artificial
  Chemically Synthesized
ugaagagaccuuagaacuu

SEQ ID NO: 4181 - RNA, 19 nt, artificial
  Chemically Synthesized
caggucgagaauguagucg

SEQ ID NO: 4182 - RNA, 19 nt, artificial
  Chemically Synthesized
aguucacaguccuucgcuc

SEQ ID NO: 4183 - RNA, 19 nt, artificial
  Chemically Synthesized
ugucguuggagaugacaag

SEQ ID NO: 4184 - RNA, 19 nt, artificial
  Chemically Synthesized
aaggcacgccucuuuauuc

SEQ ID NO: 4185 - RNA, 19 nt, artificial
  Chemically Synthesized
cagaucuuugagcuucccu

SEQ ID NO: 4186 - RNA, 19 nt, artificial
  Chemically Synthesized
guuggagaugacaaguucc

SEQ ID NO: 4187 - RNA, 19 nt, artificial
  Chemically Synthesized
acuuccagaauuugcuuuu

SEQ ID NO: 4188 - RNA, 19 nt, artificial
  Chemically Synthesized
ccaaagagaaagaaaacca

SEQ ID NO: 4189 - RNA, 19 nt, artificial
  Chemically Synthesized
ucguuggagaugacaaguu

SEQ ID NO: 4190 - RNA, 19 nt, artificial
  Chemically Synthesized
acaaguuccggagugagcu

SEQ ID NO: 4191 - RNA, 19 nt, artificial
  Chemically Synthesized
uaccugcaggucgagaaug

SEQ ID NO: 4192 - RNA, 19 nt, artificial
  Chemically Synthesized
accaaaagaagucccgcua

SEQ ID NO: 4193 - RNA, 19 nt, artificial
  Chemically Synthesized
ccuuucuccaaggagacca

SEQ ID NO: 4194 - RNA, 19 nt, artificial
  Chemically Synthesized
uucuccaaggagaccagaa

SEQ ID NO: 4195 - RNA, 19 nt, artificial
  Chemically Synthesized
aguuuggagagcagccacu

SEQ ID NO: 4196 - RNA, 19 nt, artificial
  Chemically Synthesized
accauuaacuuccagaauu

SEQ ID NO: 4197 - RNA, 19 nt, artificial
  Chemically Synthesized
uggcaaaagcuccuuuugu

SEQ ID NO: 4198 - RNA, 19 nt, artificial
  Chemically Synthesized
ugguucaugucguccagca

SEQ ID NO: 4199 - RNA, 19 nt, artificial
  Chemically Synthesized
uggaaggcacgccucuuua

SEQ ID NO: 4200 - RNA, 19 nt, artificial
  Chemically Synthesized
guucacagcccgcuuaaau

SEQ ID NO: 4201 - RNA, 19 nt, artificial
  Chemically Synthesized
uucaaagaaugaggaagcg

SEQ ID NO: 4202 - RNA, 19 nt, artificial
  Chemically Synthesized
cccagaucuuugagcuucc

SEQ ID NO: 4203 - RNA, 19 nt, artificial
  Chemically Synthesized
aaugaggaagcgcugauac

SEQ ID NO: 4204 - RNA, 19 nt, artificial
  Chemically Synthesized
ucaucauauacacaagugu

SEQ ID NO: 4205 - RNA, 19 nt, artificial
  Chemically Synthesized
ucgcauuguuacagaaagu

SEQ ID NO: 4206 - RNA, 19 nt, artificial
  Chemically Synthesized
aagcuccuuuugucguugg

SEQ ID NO: 4207 - RNA, 19 nt, artificial
  Chemically Synthesized
ucgagaauguagucgauga

SEQ ID NO: 4208 - RNA, 19 nt, artificial
  Chemically Synthesized
acgcgcuguaggauuucca

SEQ ID NO: 4209 - RNA, 19 nt, artificial
  Chemically Synthesized
ucaugucguccagcaagcu

SEQ ID NO: 4210 - RNA, 19 nt, artificial
  Chemically Synthesized
cgccucuuuauucaaaaug

SEQ ID NO: 4211 - RNA, 19 nt, artificial
  Chemically Synthesized
aacuuccagaauuugcuuu

SEQ ID NO: 4212 - RNA, 19 nt, artificial
  Chemically Synthesized
aaagucaccuuccuguaaa

SEQ ID NO: 4213 - RNA, 19 nt, artificial
  Chemically Synthesized
guaaaaaagguacaaaacc

SEQ ID NO: 4214 - RNA, 19 nt, artificial
  Chemically Synthesized
aaucagggcaacagaaccu

SEQ ID NO: 4215 - RNA, 19 nt, artificial
  Chemically Synthesized
ucaaaaccauuaacuucca

SEQ ID NO: 4216 - RNA, 19 nt, artificial
  Chemically Synthesized
uuuagucuccaggaaggga

SEQ ID NO: 4217 - RNA, 19 nt, artificial
  Chemically Synthesized
cgcuguaggauuuccaccu

SEQ ID NO: 4218 - RNA, 19 nt, artificial
  Chemically Synthesized
ccagaauuugcuuuuuccu

SEQ ID NO: 4219 - RNA, 19 nt, artificial
  Chemically Synthesized
cacagcccgcuuaaauugc

SEQ ID NO: 4220 - RNA, 19 nt, artificial
  Chemically Synthesized
aaauugcaaacaggcuucc

SEQ ID NO: 4221 - RNA, 19 nt, artificial
  Chemically Synthesized
agaaccuuucuccaaggag

SEQ ID NO: 4222 - RNA, 19 nt, artificial
  Chemically Synthesized
aauugcaaacaggcuuccu

SEQ ID NO: 4223 - RNA, 19 nt, artificial
  Chemically Synthesized
auaaaucagggcaacagaa

SEQ ID NO: 4224 - RNA, 19 nt, artificial
  Chemically Synthesized
agaccagaagaccagcucu

SEQ ID NO: 4225 - RNA, 19 nt, artificial
  Chemically Synthesized
aaaccauuaacuuccagaa

SEQ ID NO: 4226 - RNA, 19 nt, artificial
  Chemically Synthesized
augacgcgcuguaggauuu

SEQ ID NO: 4227 - RNA, 19 nt, artificial
  Chemically Synthesized
uccgccagcaaggauuuaa

SEQ ID NO: 4228 - RNA, 19 nt, artificial
  Chemically Synthesized
cagggcaacagaaccuuuc

SEQ ID NO: 4229 - RNA, 19 nt, artificial
  Chemically Synthesized
acgcucugaagagaccuua

SEQ ID NO: 4230 - RNA, 19 nt, artificial
  Chemically Synthesized
aaaagcuccuuuugucguu

SEQ ID NO: 4231 - RNA, 19 nt, artificial
  Chemically Synthesized
uuuugucguuggagaugac

SEQ ID NO: 4232 - RNA, 19 nt, artificial
  Chemically Synthesized
cuguaggauuuccaccugg

SEQ ID NO: 4233 - RNA, 19 nt, artificial
  Chemically Synthesized
gccucuuuauucaaaaugg

SEQ ID NO: 4234 - RNA, 19 nt, artificial
  Chemically Synthesized
aagaaugaggaagcgcuga

SEQ ID NO: 4235 - RNA, 19 nt, artificial
  Chemically Synthesized
ggcaacagaaccuuucucc

SEQ ID NO: 4236 - RNA, 19 nt, artificial
  Chemically Synthesized
uggugaagucaagugggca

SEQ ID NO: 4237 - RNA, 19 nt, artificial
  Chemically Synthesized
cugcaggucgagaauguag

SEQ ID NO: 4238 - RNA, 19 nt, artificial
  Chemically Synthesized
gaucuuugagcuucccugc

SEQ ID NO: 4239 - RNA, 19 nt, artificial
  Chemically Synthesized
ucuccgccagcaaggauuu

SEQ ID NO: 4240 - RNA, 19 nt, artificial
  Chemically Synthesized
agguacaaaaccuauauac

SEQ ID NO: 4241 - RNA, 19 nt, artificial
  Chemically Synthesized
aucagggcaacagaaccuu

SEQ ID NO: 4242 - RNA, 19 nt, artificial
  Chemically Synthesized
aggccacaaguucacaguc

SEQ ID NO: 4243 - RNA, 19 nt, artificial
  Chemically Synthesized
agggauuuggugaagucaa

SEQ ID NO: 4244 - RNA, 19 nt, artificial
  Chemically Synthesized
accuuucuccaaggagacc

SEQ ID NO: 4245 - RNA, 19 nt, artificial
  Chemically Synthesized
caaggagaccagaagacca

SEQ ID NO: 4246 - RNA, 19 nt, artificial
  Chemically Synthesized
uggcauaguuuggagagca

SEQ ID NO: 4247 - RNA, 19 nt, artificial
  Chemically Synthesized
cuccugagcaccagguuua

SEQ ID NO: 4248 - RNA, 19 nt, artificial
  Chemically Synthesized
agguuuagucuccaggaag

SEQ ID NO: 4249 - RNA, 19 nt, artificial
  Chemically Synthesized
augacaaguuccggaguga

SEQ ID NO: 4250 - RNA, 19 nt, artificial
  Chemically Synthesized
caaagagaaagaaaaccaa

SEQ ID NO: 4251 - RNA, 19 nt, artificial
  Chemically Synthesized
gcuuaaauugcaaacaggc

SEQ ID NO: 4252 - RNA, 19 nt, artificial
  Chemically Synthesized
cgcauuguuacagaaaguc

SEQ ID NO: 4253 - RNA, 19 nt, artificial
  Chemically Synthesized
ucagggcaacagaaccuuu

SEQ ID NO: 4254 - RNA, 19 nt, artificial
  Chemically Synthesized
gaagagaccuuagaacuug

SEQ ID NO: 4255 - RNA, 19 nt, artificial
  Chemically Synthesized
ugagcaccagguuuagucu

SEQ ID NO: 4256 - RNA, 19 nt, artificial
  Chemically Synthesized
aagggauuuggugaaguca

SEQ ID NO: 4257 - RNA, 19 nt, artificial
  Chemically Synthesized
gucaguggcaaaagcuccu

SEQ ID NO: 4258 - RNA, 19 nt, artificial
  Chemically Synthesized
ucaguggcaaaagcuccuu

SEQ ID NO: 4259 - RNA, 19 nt, artificial
  Chemically Synthesized
gcaaaagcuccuuuugucg

SEQ ID NO: 4260 - RNA, 19 nt, artificial
  Chemically Synthesized
agaaagucaccuuccugua

SEQ ID NO: 4261 - RNA, 19 nt, artificial
  Chemically Synthesized
cugaagagaccuuagaacu

SEQ ID NO: 4262 - RNA, 19 nt, artificial
  Chemically Synthesized
gagaugacaaguuccggag

SEQ ID NO: 4263 - RNA, 19 nt, artificial
  Chemically Synthesized
agcagugguucaugucguc

SEQ ID NO: 4264 - RNA, 19 nt, artificial
  Chemically Synthesized
aguggcaaaagcuccuuuu

SEQ ID NO: 4265 - RNA, 19 nt, artificial
  Chemically Synthesized
gaugacgcgcuguaggauu

SEQ ID NO: 4266 - RNA, 19 nt, artificial
  Chemically Synthesized
cuuaaauugcaaacaggcu

SEQ ID NO: 4267 - RNA, 19 nt, artificial
  Chemically Synthesized
agaaugaggaagcgcugau

SEQ ID NO: 4268 - RNA, 19 nt, artificial
  Chemically Synthesized
gucaccuuccuguaaaaaa

SEQ ID NO: 4269 - RNA, 19 nt, artificial
  Chemically Synthesized
acagaaccuuucuccaagg

SEQ ID NO: 4270 - RNA, 19 nt, artificial
  Chemically Synthesized
gcauaguuuggagagcagc

SEQ ID NO: 4271 - RNA, 19 nt, artificial
  Chemically Synthesized
ccucuuuauucaaaauggc

SEQ ID NO: 4272 - RNA, 19 nt, artificial
  Chemically Synthesized
cuuucuccaaggagaccag

SEQ ID NO: 4273 - RNA, 19 nt, artificial
  Chemically Synthesized
uccugagcaccagguuuag

SEQ ID NO: 4274 - RNA, 19 nt, artificial
  Chemically Synthesized
cauuaacuuccagaauuug

SEQ ID NO: 4275 - RNA, 19 nt, artificial
  Chemically Synthesized
acuaccugcaggucgagaa

SEQ ID NO: 4276 - RNA, 19 nt, artificial
  Chemically Synthesized
gucgagaauguagucgaug

SEQ ID NO: 4277 - RNA, 19 nt, artificial
  Chemically Synthesized
gauuuccaccuggcuaagc

SEQ ID NO: 4278 - RNA, 19 nt, artificial
  Chemically Synthesized
cagugguucaugucgucca

SEQ ID NO: 4279 - RNA, 19 nt, artificial
  Chemically Synthesized
cagcaaggauuuaaaaauc

SEQ ID NO: 4280 - RNA, 19 nt, artificial
  Chemically Synthesized
aaccuuucuccaaggagac

SEQ ID NO: 4281 - RNA, 19 nt, artificial
  Chemically Synthesized
cuuggcauaguuuggagag

SEQ ID NO: 4282 - RNA, 19 nt, artificial
  Chemically Synthesized
cuuuugucguuggagauga

SEQ ID NO: 4283 - RNA, 19 nt, artificial
  Chemically Synthesized
gaugacaaguuccggagug

SEQ ID NO: 4284 - RNA, 19 nt, artificial
  Chemically Synthesized
gagaauguagucgaugacg

SEQ ID NO: 4285 - RNA, 19 nt, artificial
  Chemically Synthesized
gcggauucaaagaaugagg

SEQ ID NO: 4286 - RNA, 19 nt, artificial
  Chemically Synthesized
uccuuuugucguuggagau

SEQ ID NO: 4287 - RNA, 19 nt, artificial
  Chemically Synthesized
gaauguagucgaugacgcg

SEQ ID NO: 4288 - RNA, 19 nt, artificial
  Chemically Synthesized
ccaaaagaagucccgcuac

SEQ ID NO: 4289 - RNA, 19 nt, artificial
  Chemically Synthesized
cgcggauucaaagaaugag

SEQ ID NO: 4290 - RNA, 19 nt, artificial
  Chemically Synthesized
cauaaaucagggcaacaga

SEQ ID NO: 4291 - RNA, 19 nt, artificial
  Chemically Synthesized
agagaccuuagaacuuggg

SEQ ID NO: 4292 - RNA, 19 nt, artificial
  Chemically Synthesized
cuccuuuugucguuggaga

SEQ ID NO: 4293 - RNA, 19 nt, artificial
  Chemically Synthesized
gcaacagaaccuuucucca

SEQ ID NO: 4294 - RNA, 19 nt, artificial
  Chemically Synthesized
agcuagcucuggcucuuca

SEQ ID NO: 4295 - RNA, 19 nt, artificial
  Chemically Synthesized
aggucgagaauguagucga

SEQ ID NO: 4296 - RNA, 19 nt, artificial
  Chemically Synthesized
aggauuuccaccuggcuaa

SEQ ID NO: 4297 - RNA, 19 nt, artificial
  Chemically Synthesized
gaaggcacgccucuuuauu

SEQ ID NO: 4298 - RNA, 19 nt, artificial
  Chemically Synthesized
aggcacgccucuuuauuca

SEQ ID NO: 4299 - RNA, 19 nt, artificial
  Chemically Synthesized
ccagaucuuugagcuuccc

SEQ ID NO: 4300 - RNA, 19 nt, artificial
  Chemically Synthesized
gcauuguuacagaaaguca

SEQ ID NO: 4301 - RNA, 19 nt, artificial
  Chemically Synthesized
caggccacaaguucacagu

SEQ ID NO: 4302 - RNA, 19 nt, artificial
  Chemically Synthesized
agugguucaugucguccag

SEQ ID NO: 4303 - RNA, 19 nt, artificial
  Chemically Synthesized
aaccauuaacuuccagaau

SEQ ID NO: 4304 - RNA, 19 nt, artificial
  Chemically Synthesized
gucuccaggaagggauuug

SEQ ID NO: 4305 - RNA, 19 nt, artificial
  Chemically Synthesized
guggcaaaagcuccuuuug

SEQ ID NO: 4306 - RNA, 19 nt, artificial
  Chemically Synthesized
gcuguaggauuuccaccug

SEQ ID NO: 4307 - RNA, 19 nt, artificial
  Chemically Synthesized
gcccgcuuaaauugcaaac

SEQ ID NO: 4308 - RNA, 19 nt, artificial
  Chemically Synthesized
guaggauuuccaccuggcu

SEQ ID NO: 4309 - RNA, 19 nt, artificial
  Chemically Synthesized
uagucuccaggaagggauu

SEQ ID NO: 4310 - RNA, 19 nt, artificial
  Chemically Synthesized
caaaagaagucccgcuaca

SEQ ID NO: 4311 - RNA, 19 nt, artificial
  Chemically Synthesized
agggcaacagaaccuuucu

SEQ ID NO: 4312 - RNA, 19 nt, artificial
  Chemically Synthesized
ccuuggcauaguuuggaga

SEQ ID NO: 4313 - RNA, 19 nt, artificial
  Chemically Synthesized
gccacaaguucacaguccu

SEQ ID NO: 4314 - RNA, 19 nt, artificial
  Chemically Synthesized
gucguuggagaugacaagu

SEQ ID NO: 4315 - RNA, 19 nt, artificial
  Chemically Synthesized
gccgcggauucaaagaaug

SEQ ID NO: 4316 - RNA, 19 nt, artificial
  Chemically Synthesized
uccuguaaaaaagguacaa

SEQ ID NO: 4317 - RNA, 19 nt, artificial
  Chemically Synthesized
cacucaaaaccauuaacuu

SEQ ID NO: 4318 - RNA, 19 nt, artificial
  Chemically Synthesized
ccaggaagggauuugguga

SEQ ID NO: 4319 - RNA, 19 nt, artificial
  Chemically Synthesized
ccuuuugucguuggagaug

SEQ ID NO: 4320 - RNA, 19 nt, artificial
  Chemically Synthesized
accugcaggucgagaaugu

SEQ ID NO: 4321 - RNA, 19 nt, artificial
  Chemically Synthesized
agaagucccgcuacaguga

SEQ ID NO: 4322 - RNA, 19 nt, artificial
  Chemically Synthesized
caucgcauuguuacagaaa

SEQ ID NO: 4323 - RNA, 19 nt, artificial
  Chemically Synthesized
cuccaaggagaccagaaga

SEQ ID NO: 4324 - RNA, 19 nt, artificial
  Chemically Synthesized
agaugacaaguuccggagu

SEQ ID NO: 4325 - RNA, 19 nt, artificial
  Chemically Synthesized
gaauuugcuuuuuccuggc

SEQ ID NO: 4326 - RNA, 19 nt, artificial
  Chemically Synthesized
cacgccucuuuauucaaaa

SEQ ID NO: 4327 - RNA, 19 nt, artificial
  Chemically Synthesized
gauucaaagaaugaggaag

SEQ ID NO: 4328 - RNA, 19 nt, artificial
  Chemically Synthesized
caucauauacacaaguguu

SEQ ID NO: 4329 - RNA, 19 nt, artificial
  Chemically Synthesized
agucaccuuccuguaaaaa

SEQ ID NO: 4330 - RNA, 19 nt, artificial
  Chemically Synthesized
caccuuccuguaaaaaagg

SEQ ID NO: 4331 - RNA, 19 nt, artificial
  Chemically Synthesized
agaguucauaaaucagggc

SEQ ID NO: 4332 - RNA, 19 nt, artificial
  Chemically Synthesized
caccagguuuagucuccag

SEQ ID NO: 4333 - RNA, 19 nt, artificial
  Chemically Synthesized
gguuuagucuccaggaagg

SEQ ID NO: 4334 - RNA, 19 nt, artificial
  Chemically Synthesized
aggaagggauuuggugaag

SEQ ID NO: 4335 - RNA, 19 nt, artificial
  Chemically Synthesized
caaaagcuccuuuugucgu

SEQ ID NO: 4336 - RNA, 19 nt, artificial
  Chemically Synthesized
gcuccuuuugucguuggag

SEQ ID NO: 4337 - RNA, 19 nt, artificial
  Chemically Synthesized
ccgcuuaaauugcaaacag

SEQ ID NO: 4338 - RNA, 19 nt, artificial
  Chemically Synthesized
ccuuccuguaaaaaaggua

SEQ ID NO: 4339 - RNA, 19 nt, artificial
  Chemically Synthesized
caacagaaccuuucuccaa

SEQ ID NO: 4340 - RNA, 19 nt, artificial
  Chemically Synthesized
caaaaccauuaacuuccag

SEQ ID NO: 4341 - RNA, 19 nt, artificial
  Chemically Synthesized
cgcucugaagagaccuuag

SEQ ID NO: 4342 - RNA, 19 nt, artificial
  Chemically Synthesized
agagcuagcucuggcucuu

SEQ ID NO: 4343 - RNA, 19 nt, artificial
  Chemically Synthesized
ccacaaguucacaguccuu

SEQ ID NO: 4344 - RNA, 19 nt, artificial
  Chemically Synthesized
ccagguuuagucuccagga

SEQ ID NO: 4345 - RNA, 19 nt, artificial
  Chemically Synthesized
cuuccagaauuugcuuuuu

SEQ ID NO: 4346 - RNA, 19 nt, artificial
  Chemically Synthesized
gaguagcagugguucaugu

SEQ ID NO: 4347 - RNA, 19 nt, artificial
  Chemically Synthesized
ggucacuuauagagccugc

SEQ ID NO: 4348 - RNA, 19 nt, artificial
  Chemically Synthesized
agccgcggauucaaagaau

SEQ ID NO: 4349 - RNA, 19 nt, artificial
  Chemically Synthesized
gcaaggauuuaaaaaucac

SEQ ID NO: 4350 - RNA, 19 nt, artificial
  Chemically Synthesized
gaguucauaaaucagggca

SEQ ID NO: 4351 - RNA, 19 nt, artificial
  Chemically Synthesized
ggcaaaagcuccuuuuguc

SEQ ID NO: 4352 - RNA, 19 nt, artificial
  Chemically Synthesized
aauuugcuuuuuccuggca

SEQ ID NO: 4353 - RNA, 19 nt, artificial
  Chemically Synthesized
cguuggagaugacaaguuc

SEQ ID NO: 4354 - RNA, 19 nt, artificial
  Chemically Synthesized
cccgcuuaaauugcaaaca

SEQ ID NO: 4355 - RNA, 19 nt, artificial
  Chemically Synthesized
gaaccuuucuccaaggaga

SEQ ID NO: 4356 - RNA, 19 nt, artificial
  Chemically Synthesized
ccauuaacuuccagaauuu

SEQ ID NO: 4357 - RNA, 19 nt, artificial
  Chemically Synthesized
cuccaggaagggauuuggu

SEQ ID NO: 4358 - RNA, 19 nt, artificial
  Chemically Synthesized
acagcccgcuuaaauugca

SEQ ID NO: 4359 - RNA, 19 nt, artificial
  Chemically Synthesized
ccgcggauucaaagaauga

SEQ ID NO: 4360 - RNA, 19 nt, artificial
  Chemically Synthesized
cucugaagagaccuuagaa

SEQ ID NO: 4361 - RNA, 19 nt, artificial
  Chemically Synthesized
guuuagucuccaggaaggg

SEQ ID NO: 4362 - RNA, 19 nt, artificial
  Chemically Synthesized
ggagaugacaaguuccgga

SEQ ID NO: 4363 - RNA, 19 nt, artificial
  Chemically Synthesized
agcccgcuuaaauugcaaa

SEQ ID NO: 4364 - RNA, 19 nt, artificial
  Chemically Synthesized
gagucaguggcaaaagcuc

SEQ ID NO: 4365 - RNA, 19 nt, artificial
  Chemically Synthesized
ggaguagcagugguucaug

SEQ ID NO: 4366 - RNA, 19 nt, artificial
  Chemically Synthesized
cggucacuuauagagccug

SEQ ID NO: 4367 - RNA, 19 nt, artificial
  Chemically Synthesized
cgcuuaaauugcaaacagg

SEQ ID NO: 4368 - RNA, 19 nt, artificial
  Chemically Synthesized
aguucauaaaucagggcaa

SEQ ID NO: 4369 - RNA, 19 nt, artificial
  Chemically Synthesized
gagcaccagguuuagucuc

SEQ ID NO: 4370 - RNA, 19 nt, artificial
  Chemically Synthesized
acaucgcauuguuacagaa

SEQ ID NO: 4371 - RNA, 19 nt, artificial
  Chemically Synthesized
cacgcucugaagagaccuu

SEQ ID NO: 4372 - RNA, 19 nt, artificial
  Chemically Synthesized
caguggcaaaagcuccuuu

SEQ ID NO: 4373 - RNA, 19 nt, artificial
  Chemically Synthesized
gcaggucgagaauguaguc

SEQ ID NO: 4374 - RNA, 19 nt, artificial
  Chemically Synthesized
gggcaacagaaccuuucuc

SEQ ID NO: 4375 - RNA, 19 nt, artificial
  Chemically Synthesized
caggaagggauuuggugaa

SEQ ID NO: 4376 - RNA, 19 nt, artificial
  Chemically Synthesized
ggaagggauuuggugaagu

SEQ ID NO: 4377 - RNA, 19 nt, artificial
  Chemically Synthesized
ccagcaaggauuuaaaaau

SEQ ID NO: 4378 - RNA, 19 nt, artificial
  Chemically Synthesized
gggauuuggugaagucaag

SEQ ID NO: 4379 - RNA, 19 nt, artificial
  Chemically Synthesized
acgccucuuuauucaaaau

SEQ ID NO: 4380 - RNA, 19 nt, artificial
  Chemically Synthesized
cggauucaaagaaugagga

SEQ ID NO: 4381 - RNA, 19 nt, artificial
  Chemically Synthesized
gaaagucaccuuccuguaa

SEQ ID NO: 4382 - RNA, 19 nt, artificial
  Chemically Synthesized
accuuccuguaaaaaaggu

SEQ ID NO: 4383 - RNA, 19 nt, artificial
  Chemically Synthesized
ccugcaggucgagaaugua

SEQ ID NO: 4384 - RNA, 19 nt, artificial
  Chemically Synthesized
aagucaccuuccuguaaaa

SEQ ID NO: 4385 - RNA, 19 nt, artificial
  Chemically Synthesized
gguacaaaaccuauauacu

SEQ ID NO: 4386 - RNA, 19 nt, artificial
  Chemically Synthesized
cgccuuggcauaguuugga

SEQ ID NO: 4387 - RNA, 19 nt, artificial
  Chemically Synthesized
gaagggauuuggugaaguc

SEQ ID NO: 4388 - RNA, 19 nt, artificial
  Chemically Synthesized
ggauuuggugaagucaagu

SEQ ID NO: 4389 - RNA, 19 nt, artificial
  Chemically Synthesized
guucauaaaucagggcaac

SEQ ID NO: 4390 - RNA, 19 nt, artificial
  Chemically Synthesized
cgagucaguggcaaaagcu

SEQ ID NO: 4391 - RNA, 19 nt, artificial
  Chemically Synthesized
gguucaugucguccagcaa

SEQ ID NO: 4392 - RNA, 19 nt, artificial
  Chemically Synthesized
gcacgccucuuuauucaaa

SEQ ID NO: 4393 - RNA, 19 nt, artificial
  Chemically Synthesized
gcucugaagagaccuuaga

SEQ ID NO: 4394 - RNA, 19 nt, artificial
  Chemically Synthesized
cagcccgcuuaaauugcaa

SEQ ID NO: 4395 - RNA, 19 nt, artificial
  Chemically Synthesized
cgagaauguagucgaugac

SEQ ID NO: 4396 - RNA, 19 nt, artificial
  Chemically Synthesized
ggcauaguuuggagagcag

SEQ ID NO: 4397 - RNA, 19 nt, artificial
  Chemically Synthesized
ccugagcaccagguuuagu

SEQ ID NO: 4398 - RNA, 19 nt, artificial
  Chemically Synthesized
gcaccagguuuagucucca

SEQ ID NO: 4399 - RNA, 19 nt, artificial
  Chemically Synthesized
agucuccaggaagggauuu

SEQ ID NO: 4400 - RNA, 19 nt, artificial
  Chemically Synthesized
agcuccuuuugucguugga

SEQ ID NO: 4401 - RNA, 19 nt, artificial
  Chemically Synthesized
gaaugaggaagcgcugaua

SEQ ID NO: 4402 - RNA, 19 nt, artificial
  Chemically Synthesized
ccgccagcaaggauuuaaa

SEQ ID NO: 4403 - RNA, 19 nt, artificial
  Chemically Synthesized
cuaccugcaggucgagaau

SEQ ID NO: 4404 - RNA, 19 nt, artificial
  Chemically Synthesized
gccuuggcauaguuuggag

SEQ ID NO: 4405 - RNA, 19 nt, artificial
  Chemically Synthesized
ccuguaaaaaagguacaaa

SEQ ID NO: 4406 - RNA, 19 nt, artificial
  Chemically Synthesized
cagguuuagucuccaggaa

SEQ ID NO: 4407 - RNA, 19 nt, artificial
  Chemically Synthesized
gggaguagcagugguucau

SEQ ID NO: 4408 - RNA, 19 nt, artificial
  Chemically Synthesized
gccagcaaggauuuaaaaa

SEQ ID NO: 4409 - RNA, 19 nt, artificial
  Chemically Synthesized
gcggucacuuauagagccu

SEQ ID NO: 4410 - RNA, 19 nt, artificial
  Chemically Synthesized
gcucuucaggccacaaguu

SEQ ID NO: 4411 - RNA, 19 nt, artificial
  Chemically Synthesized
cguucacagcccgcuuaaa

SEQ ID NO: 4412 - RNA, 19 nt, artificial
  Chemically Synthesized
cagaaccuuucuccaagga

SEQ ID NO: 4413 - RNA, 19 nt, artificial
  Chemically Synthesized
ggauuuccaccuggcuaag

SEQ ID NO: 4414 - RNA, 19 nt, artificial
  Chemically Synthesized
gagccgcggauucaaagaa

SEQ ID NO: 4415 - RNA, 19 nt, artificial
  Chemically Synthesized
cuccgccagcaaggauuua

SEQ ID NO: 4416 - RNA, 19 nt, artificial
  Chemically Synthesized
cgccagcaaggauuuaaaa

SEQ ID NO: 4417 - RNA, 19 nt, artificial
  Chemically Synthesized
ggaaggcacgccucuuuau

SEQ ID NO: 4418 - RNA, 19 nt, artificial
  Chemically Synthesized
ggcacgccucuuuauucaa

SEQ ID NO: 4419 - RNA, 19 nt, artificial
  Chemically Synthesized
ggucgagaauguagucgau

SEQ ID NO: 4420 - RNA, 19 nt, artificial
  Chemically Synthesized
ggauucaaagaaugaggaa

SEQ ID NO: 4421 - RNA, 19 nt, artificial
  Chemically Synthesized
aaacaaaagagccaacaga

SEQ ID NO: 4422 - RNA, 19 nt, artificial
  Chemically Synthesized
ccgggagaaagaugucaaa

SEQ ID NO: 4423 - RNA, 19 nt, artificial
  Chemically Synthesized
ccauauugggccacuaaaa

SEQ ID NO: 4424 - RNA, 19 nt, artificial
  Chemically Synthesized
caaaacaaaagagccaaca

SEQ ID NO: 4425 - RNA, 19 nt, artificial
  Chemically Synthesized
ggugcuugggaguuuugaa

SEQ ID NO: 4426 - RNA, 19 nt, artificial
  Chemically Synthesized
gguggaccacgaagaguua

SEQ ID NO: 4427 - RNA, 19 nt, artificial
  Chemically Synthesized
aacaaaagagccaacagaa

SEQ ID NO: 4428 - RNA, 19 nt, artificial
  Chemically Synthesized
gcauguggcuuuuuuaaaa

SEQ ID NO: 4429 - RNA, 19 nt, artificial
  Chemically Synthesized
ccuguauaagcacugaaaa

SEQ ID NO: 4430 - RNA, 19 nt, artificial
  Chemically Synthesized
ccaacagaacagaagaaaa

SEQ ID NO: 4431 - RNA, 19 nt, artificial
  Chemically Synthesized
cgcauuugguggacccaaa

SEQ ID NO: 4432 - RNA, 19 nt, artificial
  Chemically Synthesized
aaaugaucugccucuaaaa

SEQ ID NO: 4433 - RNA, 19 nt, artificial
  Chemically Synthesized
cauauugggccacuaaaaa

SEQ ID NO: 4434 - RNA, 19 nt, artificial
  Chemically Synthesized
cgauuuucagaaucacaaa

SEQ ID NO: 4435 - RNA, 19 nt, artificial
  Chemically Synthesized
cuguauaagcacugaaaaa

SEQ ID NO: 4436 - RNA, 19 nt, artificial
  Chemically Synthesized
aaaacaaaagagccaacag

SEQ ID NO: 4437 - RNA, 19 nt, artificial
  Chemically Synthesized
ugggaguuuugaauguuaa

SEQ ID NO: 4438 - RNA, 19 nt, artificial
  Chemically Synthesized
cauugccuguguauggaaa

SEQ ID NO: 4439 - RNA, 19 nt, artificial
  Chemically Synthesized
ucaaaacaaaagagccaac

SEQ ID NO: 4440 - RNA, 19 nt, artificial
  Chemically Synthesized
gugugaaaaagaugccaau

SEQ ID NO: 4441 - RNA, 19 nt, artificial
  Chemically Synthesized
cauguuuugugcauuugua

SEQ ID NO: 4442 - RNA, 19 nt, artificial
  Chemically Synthesized
aagugaaauggauacuaca

SEQ ID NO: 4443 - RNA, 19 nt, artificial
  Chemically Synthesized
cccgggagaaagaugucaa

SEQ ID NO: 4444 - RNA, 19 nt, artificial
  Chemically Synthesized
cagaagacgucaaacguaa

SEQ ID NO: 4445 - RNA, 19 nt, artificial
  Chemically Synthesized
cuguguaaacacagucaaa

SEQ ID NO: 4446 - RNA, 19 nt, artificial
  Chemically Synthesized
aguuaauuacucagcagaa

SEQ ID NO: 4447 - RNA, 19 nt, artificial
  Chemically Synthesized
cguaaacagcucgaauuaa

SEQ ID NO: 4448 - RNA, 19 nt, artificial
  Chemically Synthesized
gccauauugggccacuaaa

SEQ ID NO: 4449 - RNA, 19 nt, artificial
  Chemically Synthesized
guaggauaagugaaaugga

SEQ ID NO: 4450 - RNA, 19 nt, artificial
  Chemically Synthesized
acuuguaggauaagugaaa

SEQ ID NO: 4451 - RNA, 19 nt, artificial
  Chemically Synthesized
caaugcgcaggaauaagga

SEQ ID NO: 4452 - RNA, 19 nt, artificial
  Chemically Synthesized
ggaauuucgauuuucagaa

SEQ ID NO: 4453 - RNA, 19 nt, artificial
  Chemically Synthesized
cauacugagccaaguauaa

SEQ ID NO: 4454 - RNA, 19 nt, artificial
  Chemically Synthesized
ugcuguguuggguagaaua

SEQ ID NO: 4455 - RNA, 19 nt, artificial
  Chemically Synthesized
cuuggagaagcacugcaga

SEQ ID NO: 4456 - RNA, 19 nt, artificial
  Chemically Synthesized
cgaggugcuugggaguuuu

SEQ ID NO: 4457 - RNA, 19 nt, artificial
  Chemically Synthesized
cugaaaaacaacaacacaa

SEQ ID NO: 4458 - RNA, 19 nt, artificial
  Chemically Synthesized
ccuuguuuaucagauacau

SEQ ID NO: 4459 - RNA, 19 nt, artificial
  Chemically Synthesized
auaauucuaaaucccucga

SEQ ID NO: 4460 - RNA, 19 nt, artificial
  Chemically Synthesized
ccuuuuauguagcacauaa

SEQ ID NO: 4461 - RNA, 19 nt, artificial
  Chemically Synthesized
agaagacgucaaacguaaa

SEQ ID NO: 4462 - RNA, 19 nt, artificial
  Chemically Synthesized
aguggaauuucgauuuuca

SEQ ID NO: 4463 - RNA, 19 nt, artificial
  Chemically Synthesized
gccaauuauuguuacacau

SEQ ID NO: 4464 - RNA, 19 nt, artificial
  Chemically Synthesized
gcugcauguggcuuuuuua

SEQ ID NO: 4465 - RNA, 19 nt, artificial
  Chemically Synthesized
guauaagcacugaaaaaca

SEQ ID NO: 4466 - RNA, 19 nt, artificial
  Chemically Synthesized
agacaauauacaagccaaa

SEQ ID NO: 4467 - RNA, 19 nt, artificial
  Chemically Synthesized
cucuguaaaaacacugaaa

SEQ ID NO: 4468 - RNA, 19 nt, artificial
  Chemically Synthesized
agagaaaagcacacuugua

SEQ ID NO: 4469 - RNA, 19 nt, artificial
  Chemically Synthesized
ggauguagcauuaugcaau

SEQ ID NO: 4470 - RNA, 19 nt, artificial
  Chemically Synthesized
uccuguauaagcacugaaa

SEQ ID NO: 4471 - RNA, 19 nt, artificial
  Chemically Synthesized
gcgcaaguggaauuucgau

SEQ ID NO: 4472 - RNA, 19 nt, artificial
  Chemically Synthesized
cgccauauugggccacuaa

SEQ ID NO: 4473 - RNA, 19 nt, artificial
  Chemically Synthesized
gggaguuuugaauguuaag

SEQ ID NO: 4474 - RNA, 19 nt, artificial
  Chemically Synthesized
agcgcaaguggaauuucga

SEQ ID NO: 4475 - RNA, 19 nt, artificial
  Chemically Synthesized
ucauguagagaaaagcaca

SEQ ID NO: 4476 - RNA, 19 nt, artificial
  Chemically Synthesized
aaauuugaacacuggcuaa

SEQ ID NO: 4477 - RNA, 19 nt, artificial
  Chemically Synthesized
cgguuuuguuuuuuugaga

SEQ ID NO: 4478 - RNA, 19 nt, artificial
  Chemically Synthesized
gagccaacagaacagaaga

SEQ ID NO: 4479 - RNA, 19 nt, artificial
  Chemically Synthesized
aggauaagugaaauggaua

SEQ ID NO: 4480 - RNA, 19 nt, artificial
  Chemically Synthesized
ggguuugaauuguuuucuu

SEQ ID NO: 4481 - RNA, 19 nt, artificial
  Chemically Synthesized
gcuucauuguacuaccugu

SEQ ID NO: 4482 - RNA, 19 nt, artificial
  Chemically Synthesized
gcaauuagguuuuuccuua

SEQ ID NO: 4483 - RNA, 19 nt, artificial
  Chemically Synthesized
aguggcaagagguggagaa

SEQ ID NO: 4484 - RNA, 19 nt, artificial
  Chemically Synthesized
gcauacugagccaaguaua

SEQ ID NO: 4485 - RNA, 19 nt, artificial
  Chemically Synthesized
uagacaauauacaagccaa

SEQ ID NO: 4486 - RNA, 19 nt, artificial
  Chemically Synthesized
uauugggccacuaaaaaaa

SEQ ID NO: 4487 - RNA, 19 nt, artificial
  Chemically Synthesized
aguuuauucucauuuggga

SEQ ID NO: 4488 - RNA, 19 nt, artificial
  Chemically Synthesized
cauuguacuaccuguguau

SEQ ID NO: 4489 - RNA, 19 nt, artificial
  Chemically Synthesized
ccuuauuugcuucauugua

SEQ ID NO: 4490 - RNA, 19 nt, artificial
  Chemically Synthesized
gcucgccaguccauuugau

SEQ ID NO: 4491 - RNA, 19 nt, artificial
  Chemically Synthesized
aguguaccuguguacauaa

SEQ ID NO: 4492 - RNA, 19 nt, artificial
  Chemically Synthesized
cccucgauauuuuuaaaga

SEQ ID NO: 4493 - RNA, 19 nt, artificial
  Chemically Synthesized
ugaccaucugcuuuuauua

SEQ ID NO: 4494 - RNA, 19 nt, artificial
  Chemically Synthesized
auauugggccacuaaaaaa

SEQ ID NO: 4495 - RNA, 19 nt, artificial
  Chemically Synthesized
cuguguacauaacucugua

SEQ ID NO: 4496 - RNA, 19 nt, artificial
  Chemically Synthesized
gaauguuaagaauugacca

SEQ ID NO: 4497 - RNA, 19 nt, artificial
  Chemically Synthesized
aacacuggcuaaagauaau

SEQ ID NO: 4498 - RNA, 19 nt, artificial
  Chemically Synthesized
gguuuuuccuuauuugcuu

SEQ ID NO: 4499 - RNA, 19 nt, artificial
  Chemically Synthesized
gcacugaaaaacaacaaca

SEQ ID NO: 4500 - RNA, 19 nt, artificial
  Chemically Synthesized
ggccucagaagacgucaaa

SEQ ID NO: 4501 - RNA, 19 nt, artificial
  Chemically Synthesized
acaaaagagccaacagaac

SEQ ID NO: 4502 - RNA, 19 nt, artificial
  Chemically Synthesized
ggguaugaagagcuugcuu

SEQ ID NO: 4503 - RNA, 19 nt, artificial
  Chemically Synthesized
aagagccaacagaacagaa

SEQ ID NO: 4504 - RNA, 19 nt, artificial
  Chemically Synthesized
gcauguuuugugcauuugu

SEQ ID NO: 4505 - RNA, 19 nt, artificial
  Chemically Synthesized
cucuguccauuuauccaca

SEQ ID NO: 4506 - RNA, 19 nt, artificial
  Chemically Synthesized
agaucuguaaguaacuuca

SEQ ID NO: 4507 - RNA, 19 nt, artificial
  Chemically Synthesized
ggcuguguaaacacaguca

SEQ ID NO: 4508 - RNA, 19 nt, artificial
  Chemically Synthesized
gauucuucuacucaaaaca

SEQ ID NO: 4509 - RNA, 19 nt, artificial
  Chemically Synthesized
acugcagagacauggaaga

SEQ ID NO: 4510 - RNA, 19 nt, artificial
  Chemically Synthesized
caguuaauuacucagcaga

SEQ ID NO: 4511 - RNA, 19 nt, artificial
  Chemically Synthesized
agauguaaugucccuuuca

SEQ ID NO: 4512 - RNA, 19 nt, artificial
  Chemically Synthesized
gauguagcauuaugcaauu

SEQ ID NO: 4513 - RNA, 19 nt, artificial
  Chemically Synthesized
acugaaaaacaacaacaca

SEQ ID NO: 4514 - RNA, 19 nt, artificial
  Chemically Synthesized
aaacguaaacagcucgaau

SEQ ID NO: 4515 - RNA, 19 nt, artificial
  Chemically Synthesized
acgauucuucuacucaaaa

SEQ ID NO: 4516 - RNA, 19 nt, artificial
  Chemically Synthesized
gcaaccgacgauucuucua

SEQ ID NO: 4517 - RNA, 19 nt, artificial
  Chemically Synthesized
aaugcgcaggaauaaggaa

SEQ ID NO: 4518 - RNA, 19 nt, artificial
  Chemically Synthesized
ugccaauuauuguuacaca

SEQ ID NO: 4519 - RNA, 19 nt, artificial
  Chemically Synthesized
gaugccaauuauuguuaca

SEQ ID NO: 4520 - RNA, 19 nt, artificial
  Chemically Synthesized
aaguguaccuguguacaua

SEQ ID NO: 4521 - RNA, 19 nt, artificial
  Chemically Synthesized
auucuaaaucccucgauau

SEQ ID NO: 4522 - RNA, 19 nt, artificial
  Chemically Synthesized
gcuguguaaacacagucaa

SEQ ID NO: 4523 - RNA, 19 nt, artificial
  Chemically Synthesized
cugcauguggcuuuuuuaa

SEQ ID NO: 4524 - RNA, 19 nt, artificial
  Chemically Synthesized
gagacagcugauacuucau

SEQ ID NO: 4525 - RNA, 19 nt, artificial
  Chemically Synthesized
cauccuguauaagcacuga

SEQ ID NO: 4526 - RNA, 19 nt, artificial
  Chemically Synthesized
cagauacaucacugcuuga

SEQ ID NO: 4527 - RNA, 19 nt, artificial
  Chemically Synthesized
gggucugugucuuuuggcu

SEQ ID NO: 4528 - RNA, 19 nt, artificial
  Chemically Synthesized
cucaaaacaaaagagccaa

SEQ ID NO: 4529 - RNA, 19 nt, artificial
  Chemically Synthesized
agcacugcagagacaugga

SEQ ID NO: 4530 - RNA, 19 nt, artificial
  Chemically Synthesized
aauaauucuaaaucccucg

SEQ ID NO: 4531 - RNA, 19 nt, artificial
  Chemically Synthesized
cgggcuguguaaacacagu

SEQ ID NO: 4532 - RNA, 19 nt, artificial
  Chemically Synthesized
uggugaucucccaagcuau

SEQ ID NO: 4533 - RNA, 19 nt, artificial
  Chemically Synthesized
agaucuggugaucucccaa

SEQ ID NO: 4534 - RNA, 19 nt, artificial
  Chemically Synthesized
gaaggguuugaauuguuuu

SEQ ID NO: 4535 - RNA, 19 nt, artificial
  Chemically Synthesized
cguuggauguagcauuaug

SEQ ID NO: 4536 - RNA, 19 nt, artificial
  Chemically Synthesized
aagcaaggaagauauacau

SEQ ID NO: 4537 - RNA, 19 nt, artificial
  Chemically Synthesized
uggccucagaagacgucaa

SEQ ID NO: 4538 - RNA, 19 nt, artificial
  Chemically Synthesized
auaaggaagcgaccugcaa

SEQ ID NO: 4539 - RNA, 19 nt, artificial
  Chemically Synthesized
gcuugcccgaguucuacua

SEQ ID NO: 4540 - RNA, 19 nt, artificial
  Chemically Synthesized
ccauuugaaguguaccugu

SEQ ID NO: 4541 - RNA, 19 nt, artificial
  Chemically Synthesized
gcuuacucuguccauuuau

SEQ ID NO: 4542 - RNA, 19 nt, artificial
  Chemically Synthesized
uugggaguuuugaauguua

SEQ ID NO: 4543 - RNA, 19 nt, artificial
  Chemically Synthesized
ugauuuacagcaaguagau

SEQ ID NO: 4544 - RNA, 19 nt, artificial
  Chemically Synthesized
cuuaaaugaucugccucua

SEQ ID NO: 4545 - RNA, 19 nt, artificial
  Chemically Synthesized
gcccgaguucuacuacaga

SEQ ID NO: 4546 - RNA, 19 nt, artificial
  Chemically Synthesized
guaaaugcuguguugggua

SEQ ID NO: 4547 - RNA, 19 nt, artificial
  Chemically Synthesized
cacuuguaggauaagugaa

SEQ ID NO: 4548 - RNA, 19 nt, artificial
  Chemically Synthesized
uggauguagcauuaugcaa

SEQ ID NO: 4549 - RNA, 19 nt, artificial
  Chemically Synthesized
uggaauuucgauuuucaga

SEQ ID NO: 4550 - RNA, 19 nt, artificial
  Chemically Synthesized
ugugugaaaaagaugccaa

SEQ ID NO: 4551 - RNA, 19 nt, artificial
  Chemically Synthesized
aaugcuguguuggguagaa

SEQ ID NO: 4552 - RNA, 19 nt, artificial
  Chemically Synthesized
guauggaaaaaccauuuga

SEQ ID NO: 4553 - RNA, 19 nt, artificial
  Chemically Synthesized
cuguguauggaaaaaccau

SEQ ID NO: 4554 - RNA, 19 nt, artificial
  Chemically Synthesized
ucauugccuguguauggaa

SEQ ID NO: 4555 - RNA, 19 nt, artificial
  Chemically Synthesized
cuuguaggauaagugaaau

SEQ ID NO: 4556 - RNA, 19 nt, artificial
  Chemically Synthesized
guucauguagagaaaagca

SEQ ID NO: 4557 - RNA, 19 nt, artificial
  Chemically Synthesized
cuaaaucccucgauauuuu

SEQ ID NO: 4558 - RNA, 19 nt, artificial
  Chemically Synthesized
guguaaacacagucaaaau

SEQ ID NO: 4559 - RNA, 19 nt, artificial
  Chemically Synthesized
gcuugggaguuuugaaugu

SEQ ID NO: 4560 - RNA, 19 nt, artificial
  Chemically Synthesized
gugcuugggaguuuugaau

SEQ ID NO: 4561 - RNA, 19 nt, artificial
  Chemically Synthesized
aggugcuugggaguuuuga

SEQ ID NO: 4562 - RNA, 19 nt, artificial
  Chemically Synthesized
cgcuuuguuuuguucgguu

SEQ ID NO: 4563 - RNA, 19 nt, artificial
  Chemically Synthesized
augaagcaaggaagauaua

SEQ ID NO: 4564 - RNA, 19 nt, artificial
  Chemically Synthesized
aaaagagccaacagaacag

SEQ ID NO: 4565 - RNA, 19 nt, artificial
  Chemically Synthesized
gcaggaauaaggaagcgac

SEQ ID NO: 4566 - RNA, 19 nt, artificial
  Chemically Synthesized
gugaaaaagaugccaauua

SEQ ID NO: 4567 - RNA, 19 nt, artificial
  Chemically Synthesized
uucacuucgggcuguguaa

SEQ ID NO: 4568 - RNA, 19 nt, artificial
  Chemically Synthesized
ggaguuuugaauguuaaga

SEQ ID NO: 4569 - RNA, 19 nt, artificial
  Chemically Synthesized
gauuuacagcaaguagaua

SEQ ID NO: 4570 - RNA, 19 nt, artificial
  Chemically Synthesized
aagcacugaaaaacaacaa

SEQ ID NO: 4571 - RNA, 19 nt, artificial
  Chemically Synthesized
cauuugguggacccaaaga

SEQ ID NO: 4572 - RNA, 19 nt, artificial
  Chemically Synthesized
auugccuguguauggaaaa

SEQ ID NO: 4573 - RNA, 19 nt, artificial
  Chemically Synthesized
guggaccacgaagaguuaa

SEQ ID NO: 4574 - RNA, 19 nt, artificial
  Chemically Synthesized
aauugaccaucugcuuuua

SEQ ID NO: 4575 - RNA, 19 nt, artificial
  Chemically Synthesized
agucucucuuaaaguugga

SEQ ID NO: 4576 - RNA, 19 nt, artificial
  Chemically Synthesized
acagcugauacuucauuua

SEQ ID NO: 4577 - RNA, 19 nt, artificial
  Chemically Synthesized
ucauuguacuaccugugua

SEQ ID NO: 4578 - RNA, 19 nt, artificial
  Chemically Synthesized
cauggaauggacauccugu

SEQ ID NO: 4579 - RNA, 19 nt, artificial
  Chemically Synthesized
cuugaugaagcaaggaaga

SEQ ID NO: 4580 - RNA, 19 nt, artificial
  Chemically Synthesized
gcucgaauuaagaauaugu

SEQ ID NO: 4581 - RNA, 19 nt, artificial
  Chemically Synthesized
aagaagccuggccucagaa

SEQ ID NO: 4582 - RNA, 19 nt, artificial
  Chemically Synthesized
uggcuaugcuuaaaagguu

SEQ ID NO: 4583 - RNA, 19 nt, artificial
  Chemically Synthesized
ccuguguauggaaaaacca

SEQ ID NO: 4584 - RNA, 19 nt, artificial
  Chemically Synthesized
agugaaauggauacuacau

SEQ ID NO: 4585 - RNA, 19 nt, artificial
  Chemically Synthesized
agaugucaaacgugcgagu

SEQ ID NO: 4586 - RNA, 19 nt, artificial
  Chemically Synthesized
aaaagcaacagaaaccuau

SEQ ID NO: 4587 - RNA, 19 nt, artificial
  Chemically Synthesized
uggcuaaagauaauugcua

SEQ ID NO: 4588 - RNA, 19 nt, artificial
  Chemically Synthesized
caugaagagaagcaauuuu

SEQ ID NO: 4589 - RNA, 19 nt, artificial
  Chemically Synthesized
gcuugaugaagcaaggaag

SEQ ID NO: 4590 - RNA, 19 nt, artificial
  Chemically Synthesized
agaagaaaauguuucagac

SEQ ID NO: 4591 - RNA, 19 nt, artificial
  Chemically Synthesized
gccaacagaacagaagaaa

SEQ ID NO: 4592 - RNA, 19 nt, artificial
  Chemically Synthesized
agccaacagaacagaagaa

SEQ ID NO: 4593 - RNA, 19 nt, artificial
  Chemically Synthesized
caaagacugauccgucgga

SEQ ID NO: 4594 - RNA, 19 nt, artificial
  Chemically Synthesized
cugaggacacgcauuuggu

SEQ ID NO: 4595 - RNA, 19 nt, artificial
  Chemically Synthesized
gguugcauacugagccaag

SEQ ID NO: 4596 - RNA, 19 nt, artificial
  Chemically Synthesized
aguuaacccgggacuugga

SEQ ID NO: 4597 - RNA, 19 nt, artificial
  Chemically Synthesized
ggauaagugaaauggauac

SEQ ID NO: 4598 - RNA, 19 nt, artificial
  Chemically Synthesized
aagguucauguagagaaaa

SEQ ID NO: 4599 - RNA, 19 nt, artificial
  Chemically Synthesized
gcaaaaauccgaggugcuu

SEQ ID NO: 4600 - RNA, 19 nt, artificial
  Chemically Synthesized
aaaaagcaacagaaaccua

SEQ ID NO: 4601 - RNA, 19 nt, artificial
  Chemically Synthesized
cauuugggagaucugguga

SEQ ID NO: 4602 - RNA, 19 nt, artificial
  Chemically Synthesized
uugacuugcaugaagagaa

SEQ ID NO: 4603 - RNA, 19 nt, artificial
  Chemically Synthesized
uguuuuuuugagagugcga

SEQ ID NO: 4604 - RNA, 19 nt, artificial
  Chemically Synthesized
gcauuaugcaauuagguuu

SEQ ID NO: 4605 - RNA, 19 nt, artificial
  Chemically Synthesized
ccugcaaccgacgauucuu

SEQ ID NO: 4606 - RNA, 19 nt, artificial
  Chemically Synthesized
ugguggacccaaagacuga

SEQ ID NO: 4607 - RNA, 19 nt, artificial
  Chemically Synthesized
guggaauuucgauuuucag

SEQ ID NO: 4608 - RNA, 19 nt, artificial
  Chemically Synthesized
ggcuaugcuuaaaagguug

SEQ ID NO: 4609 - RNA, 19 nt, artificial
  Chemically Synthesized
aagccaaaguggcauguuu

SEQ ID NO: 4610 - RNA, 19 nt, artificial
  Chemically Synthesized
uugccuguguauggaaaaa

SEQ ID NO: 4611 - RNA, 19 nt, artificial
  Chemically Synthesized
uucuaaaucccucgauauu

SEQ ID NO: 4612 - RNA, 19 nt, artificial
  Chemically Synthesized
ccaguuaauuacucagcag

SEQ ID NO: 4613 - RNA, 19 nt, artificial
  Chemically Synthesized
aucucccaagcuaucuaaa

SEQ ID NO: 4614 - RNA, 19 nt, artificial
  Chemically Synthesized
gcguuggauguagcauuau

SEQ ID NO: 4615 - RNA, 19 nt, artificial
  Chemically Synthesized
acaacaacacaauaacacu

SEQ ID NO: 4616 - RNA, 19 nt, artificial
  Chemically Synthesized
uaagcacugaaaaacaaca

SEQ ID NO: 4617 - RNA, 19 nt, artificial
  Chemically Synthesized
uaucgcugacuucauggaa

SEQ ID NO: 4618 - RNA, 19 nt, artificial
  Chemically Synthesized
agaaaauguuucagacggu

SEQ ID NO: 4619 - RNA, 19 nt, artificial
  Chemically Synthesized
acucaaaacaaaagagcca

SEQ ID NO: 4620 - RNA, 19 nt, artificial
  Chemically Synthesized
cgauucuucuacucaaaac

SEQ ID NO: 4621 - RNA, 19 nt, artificial
  Chemically Synthesized
cuaacucugaggacacgca

SEQ ID NO: 4622 - RNA, 19 nt, artificial
  Chemically Synthesized
gacuuggagaagcacugca

SEQ ID NO: 4623 - RNA, 19 nt, artificial
  Chemically Synthesized
uagagaaaagcacacuugu

SEQ ID NO: 4624 - RNA, 19 nt, artificial
  Chemically Synthesized
gagaucuggugaucuccca

SEQ ID NO: 4625 - RNA, 19 nt, artificial
  Chemically Synthesized
gcuuuguuuuguucgguuu

SEQ ID NO: 4626 - RNA, 19 nt, artificial
  Chemically Synthesized
uggacauccuguauaagca

SEQ ID NO: 4627 - RNA, 19 nt, artificial
  Chemically Synthesized
auggaauggacauccugua

SEQ ID NO: 4628 - RNA, 19 nt, artificial
  Chemically Synthesized
cugugucuuuuggcuccga

SEQ ID NO: 4629 - RNA, 19 nt, artificial
  Chemically Synthesized
caaacguaaacagcucgaa

SEQ ID NO: 4630 - RNA, 19 nt, artificial
  Chemically Synthesized
gaaaauguuucagacgguu

SEQ ID NO: 4631 - RNA, 19 nt, artificial
  Chemically Synthesized
cagaagaaaauguuucaga

SEQ ID NO: 4632 - RNA, 19 nt, artificial
  Chemically Synthesized
ccgacgauucuucuacuca

SEQ ID NO: 4633 - RNA, 19 nt, artificial
  Chemically Synthesized
gguggacccaaagacugau

SEQ ID NO: 4634 - RNA, 19 nt, artificial
  Chemically Synthesized
guugcauacugagccaagu

SEQ ID NO: 4635 - RNA, 19 nt, artificial
  Chemically Synthesized
uggagaagcacugcagaga

SEQ ID NO: 4636 - RNA, 19 nt, artificial
  Chemically Synthesized
ccauuuauccacaggaaag

SEQ ID NO: 4637 - RNA, 19 nt, artificial
  Chemically Synthesized
uccauuuauccacaggaaa

SEQ ID NO: 4638 - RNA, 19 nt, artificial
  Chemically Synthesized
ucagcagaauggugaucac

SEQ ID NO: 4639 - RNA, 19 nt, artificial
  Chemically Synthesized
guagcauuaugcaauuagg

SEQ ID NO: 4640 - RNA, 19 nt, artificial
  Chemically Synthesized
cacuaaaauuuuaggcacu

SEQ ID NO: 4641 - RNA, 19 nt, artificial
  Chemically Synthesized
ggacauccuguauaagcac

SEQ ID NO: 4642 - RNA, 19 nt, artificial
  Chemically Synthesized
aagacugauccgucggaca

SEQ ID NO: 4643 - RNA, 19 nt, artificial
  Chemically Synthesized
ucgauuuucagaaucacaa

SEQ ID NO: 4644 - RNA, 19 nt, artificial
  Chemically Synthesized
cgcaaguggaauuucgauu

SEQ ID NO: 4645 - RNA, 19 nt, artificial
  Chemically Synthesized
aaggaagguucauguagag

SEQ ID NO: 4646 - RNA, 19 nt, artificial
  Chemically Synthesized
uauccacaggaaaguguua

SEQ ID NO: 4647 - RNA, 19 nt, artificial
  Chemically Synthesized
acuucgggcuguguaaaca

SEQ ID NO: 4648 - RNA, 19 nt, artificial
  Chemically Synthesized
uuuuuuugagagugcgaga

SEQ ID NO: 4649 - RNA, 19 nt, artificial
  Chemically Synthesized
aaaagcguuggauguagca

SEQ ID NO: 4650 - RNA, 19 nt, artificial
  Chemically Synthesized
aagguugcauacugagcca

SEQ ID NO: 4651 - RNA, 19 nt, artificial
  Chemically Synthesized
uguuggguagaauagguuu

SEQ ID NO: 4652 - RNA, 19 nt, artificial
  Chemically Synthesized
uguguuggguagaauaggu

SEQ ID NO: 4653 - RNA, 19 nt, artificial
  Chemically Synthesized
acgaagaguuaacccggga

SEQ ID NO: 4654 - RNA, 19 nt, artificial
  Chemically Synthesized
acacuuguaggauaaguga

SEQ ID NO: 4655 - RNA, 19 nt, artificial
  Chemically Synthesized
uguguaaacacagucaaaa

SEQ ID NO: 4656 - RNA, 19 nt, artificial
  Chemically Synthesized
cucucuuaaaguuggaauu

SEQ ID NO: 4657 - RNA, 19 nt, artificial
  Chemically Synthesized
caacagaaaccuauccuca

SEQ ID NO: 4658 - RNA, 19 nt, artificial
  Chemically Synthesized
aguuuguuagauagcugca

SEQ ID NO: 4659 - RNA, 19 nt, artificial
  Chemically Synthesized
aaaauuugaacacuggcua

SEQ ID NO: 4660 - RNA, 19 nt, artificial
  Chemically Synthesized
aagagcuugcuuugauuua

SEQ ID NO: 4661 - RNA, 19 nt, artificial
  Chemically Synthesized
aagcguuggauguagcauu

SEQ ID NO: 4662 - RNA, 19 nt, artificial
  Chemically Synthesized
guuuccuuguuuaucagau

SEQ ID NO: 4663 - RNA, 19 nt, artificial
  Chemically Synthesized
gcauuugguggacccaaag

SEQ ID NO: 4664 - RNA, 19 nt, artificial
  Chemically Synthesized
cacugcagagacauggaag

SEQ ID NO: 4665 - RNA, 19 nt, artificial
  Chemically Synthesized
gaagcacugcagagacaug

SEQ ID NO: 4666 - RNA, 19 nt, artificial
  Chemically Synthesized
gugcauuuguaaaugcugu

SEQ ID NO: 4667 - RNA, 19 nt, artificial
  Chemically Synthesized
gaaguguaccuguguacau

SEQ ID NO: 4668 - RNA, 19 nt, artificial
  Chemically Synthesized
uuugaaguguaccugugua

SEQ ID NO: 4669 - RNA, 19 nt, artificial
  Chemically Synthesized
uaauucuaaaucccucgau

SEQ ID NO: 4670 - RNA, 19 nt, artificial
  Chemically Synthesized
uguuaagaauugaccaucu

SEQ ID NO: 4671 - RNA, 19 nt, artificial
  Chemically Synthesized
cagaauggugaucacucca

SEQ ID NO: 4672 - RNA, 19 nt, artificial
  Chemically Synthesized
aauuugaacacuggcuaaa

SEQ ID NO: 4673 - RNA, 19 nt, artificial
  Chemically Synthesized
cccuuucagagacagcuga

SEQ ID NO: 4674 - RNA, 19 nt, artificial
  Chemically Synthesized
auguaaugucccuuucaga

SEQ ID NO: 4675 - RNA, 19 nt, artificial
  Chemically Synthesized
ugacuucauggaauggaca

SEQ ID NO: 4676 - RNA, 19 nt, artificial
  Chemically Synthesized
aucgcugacuucauggaau

SEQ ID NO: 4677 - RNA, 19 nt, artificial
  Chemically Synthesized
gcuguguuggguagaauag

SEQ ID NO: 4678 - RNA, 19 nt, artificial
  Chemically Synthesized
gcacacuuguaggauaagu

SEQ ID NO: 4679 - RNA, 19 nt, artificial
  Chemically Synthesized
uguagagaaaagcacacuu

SEQ ID NO: 4680 - RNA, 19 nt, artificial
  Chemically Synthesized
aagaauugaccaucugcuu

SEQ ID NO: 4681 - RNA, 19 nt, artificial
  Chemically Synthesized
gucucucuuaaaguuggaa

SEQ ID NO: 4682 - RNA, 19 nt, artificial
  Chemically Synthesized
cuugcaugaagagaagcaa

SEQ ID NO: 4683 - RNA, 19 nt, artificial
  Chemically Synthesized
cucuaaaagcguuggaugu

SEQ ID NO: 4684 - RNA, 19 nt, artificial
  Chemically Synthesized
caaaugccgguucugugga

SEQ ID NO: 4685 - RNA, 19 nt, artificial
  Chemically Synthesized
uaacucugaggacacgcau

SEQ ID NO: 4686 - RNA, 19 nt, artificial
  Chemically Synthesized
cuagagggcaaguacgagu

SEQ ID NO: 4687 - RNA, 19 nt, artificial
  Chemically Synthesized
ucgccaguccauuugauca

SEQ ID NO: 4688 - RNA, 19 nt, artificial
  Chemically Synthesized
cagcgcaaguggaauuucg

SEQ ID NO: 4689 - RNA, 19 nt, artificial
  Chemically Synthesized
guguacauaacucuguaaa

SEQ ID NO: 4690 - RNA, 19 nt, artificial
  Chemically Synthesized
guguauggaaaaaccauuu

SEQ ID NO: 4691 - RNA, 19 nt, artificial
  Chemically Synthesized
aaccgacgauucuucuacu

SEQ ID NO: 4692 - RNA, 19 nt, artificial
  Chemically Synthesized
aguacgaguggcaagaggu

SEQ ID NO: 4693 - RNA, 19 nt, artificial
  Chemically Synthesized
cugagccaaguauaauuuu

SEQ ID NO: 4694 - RNA, 19 nt, artificial
  Chemically Synthesized
uggcauguuuugugcauuu

SEQ ID NO: 4695 - RNA, 19 nt, artificial
  Chemically Synthesized
aguggcauguuuugugcau

SEQ ID NO: 4696 - RNA, 19 nt, artificial
  Chemically Synthesized
acucuguaaaaacacugaa

SEQ ID NO: 4697 - RNA, 19 nt, artificial
  Chemically Synthesized
ggauacuacaucuuuaaac

SEQ ID NO: 4698 - RNA, 19 nt, artificial
  Chemically Synthesized
uggugaucacuccagguag

SEQ ID NO: 4699 - RNA, 19 nt, artificial
  Chemically Synthesized
aaagaugucaaacgugcga

SEQ ID NO: 4700 - RNA, 19 nt, artificial
  Chemically Synthesized
gggagaaagaugucaaacg

SEQ ID NO: 4701 - RNA, 19 nt, artificial
  Chemically Synthesized
guuuguuagauagcugcau

SEQ ID NO: 4702 - RNA, 19 nt, artificial
  Chemically Synthesized
cuggcuaaagauaauugcu

SEQ ID NO: 4703 - RNA, 19 nt, artificial
  Chemically Synthesized
ccucuaaaagcguuggaug

SEQ ID NO: 4704 - RNA, 19 nt, artificial
  Chemically Synthesized
cugacuucauggaauggac

SEQ ID NO: 4705 - RNA, 19 nt, artificial
  Chemically Synthesized
uacauaucgcugacuucau

SEQ ID NO: 4706 - RNA, 19 nt, artificial
  Chemically Synthesized
acgcauuugguggacccaa

SEQ ID NO: 4707 - RNA, 19 nt, artificial
  Chemically Synthesized
uaacccgggacuuggagaa

SEQ ID NO: 4708 - RNA, 19 nt, artificial
  Chemically Synthesized
gaaagaugucaaacgugcg

SEQ ID NO: 4709 - RNA, 19 nt, artificial
  Chemically Synthesized
agacccgggagaaagaugu

SEQ ID NO: 4710 - RNA, 19 nt, artificial
  Chemically Synthesized
cuuucagagacagcugaua

SEQ ID NO: 4711 - RNA, 19 nt, artificial
  Chemically Synthesized
uugauuuacagcaaguaga

SEQ ID NO: 4712 - RNA, 19 nt, artificial
  Chemically Synthesized
uuuaggcacucuuaaauga

SEQ ID NO: 4713 - RNA, 19 nt, artificial
  Chemically Synthesized
auccuguauaagcacugaa

SEQ ID NO: 4714 - RNA, 19 nt, artificial
  Chemically Synthesized
aauaaggaagcgaccugca

SEQ ID NO: 4715 - RNA, 19 nt, artificial
  Chemically Synthesized
aggacacgcauuuggugga

SEQ ID NO: 4716 - RNA, 19 nt, artificial
  Chemically Synthesized
aacucugaggacacgcauu

SEQ ID NO: 4717 - RNA, 19 nt, artificial
  Chemically Synthesized
auauggcuaugcuuaaaag

SEQ ID NO: 4718 - RNA, 19 nt, artificial
  Chemically Synthesized
guguuggguagaauagguu

SEQ ID NO: 4719 - RNA, 19 nt, artificial
  Chemically Synthesized
aacucuguaaaaacacuga

SEQ ID NO: 4720 - RNA, 19 nt, artificial
  Chemically Synthesized
agguucauguagagaaaag

SEQ ID NO: 4721 - RNA, 19 nt, artificial
  Chemically Synthesized
gaauggugaucacuccagg

SEQ ID NO: 4722 - RNA, 19 nt, artificial
  Chemically Synthesized
cagucucucuuaaaguugg

SEQ ID NO: 4723 - RNA, 19 nt, artificial
  Chemically Synthesized
ugaagagaagcaauuuugg

SEQ ID NO: 4724 - RNA, 19 nt, artificial
  Chemically Synthesized
cagaacagaagaaaauguu

SEQ ID NO: 4725 - RNA, 19 nt, artificial
  Chemically Synthesized
ccauuugaucagcggagac

SEQ ID NO: 4726 - RNA, 19 nt, artificial
  Chemically Synthesized
augcuguguuggguagaau

SEQ ID NO: 4727 - RNA, 19 nt, artificial
  Chemically Synthesized
ggcaaaaauccgaggugcu

SEQ ID NO: 4728 - RNA, 19 nt, artificial
  Chemically Synthesized
cucauuugggagaucuggu

SEQ ID NO: 4729 - RNA, 19 nt, artificial
  Chemically Synthesized
cacaaaaauuugaacacug

SEQ ID NO: 4730 - RNA, 19 nt, artificial
  Chemically Synthesized
gcuuugauuuacagcaagu

SEQ ID NO: 4731 - RNA, 19 nt, artificial
  Chemically Synthesized
acucuuaaaugaucugccu

SEQ ID NO: 4732 - RNA, 19 nt, artificial
  Chemically Synthesized
agagccaacagaacagaag

SEQ ID NO: 4733 - RNA, 19 nt, artificial
  Chemically Synthesized
aaagagccaacagaacaga

SEQ ID NO: 4734 - RNA, 19 nt, artificial
  Chemically Synthesized
agguugcauacugagccaa

SEQ ID NO: 4735 - RNA, 19 nt, artificial
  Chemically Synthesized
gcuuaaaagguugcauacu

SEQ ID NO: 4736 - RNA, 19 nt, artificial
  Chemically Synthesized
guuggguagaauagguuuu

SEQ ID NO: 4737 - RNA, 19 nt, artificial
  Chemically Synthesized
aguauuucauugccugugu

SEQ ID NO: 4738 - RNA, 19 nt, artificial
  Chemically Synthesized
gguucauguagagaaaagc

SEQ ID NO: 4739 - RNA, 19 nt, artificial
  Chemically Synthesized
cauuuauccacaggaaagu

SEQ ID NO: 4740 - RNA, 19 nt, artificial
  Chemically Synthesized
uacucuguccauuuaucca

SEQ ID NO: 4741 - RNA, 19 nt, artificial
  Chemically Synthesized
aucuguaaguaacuucaca

SEQ ID NO: 4742 - RNA, 19 nt, artificial
  Chemically Synthesized
aauggugaucacuccaggu

SEQ ID NO: 4743 - RNA, 19 nt, artificial
  Chemically Synthesized
cagcagaauggugaucacu

SEQ ID NO: 4744 - RNA, 19 nt, artificial
  Chemically Synthesized
accaguuaauuacucagca

SEQ ID NO: 4745 - RNA, 19 nt, artificial
  Chemically Synthesized
cgggagaaagaugucaaac

SEQ ID NO: 4746 - RNA, 19 nt, artificial
  Chemically Synthesized
ugaucucccaagcuaucua

SEQ ID NO: 4747 - RNA, 19 nt, artificial
  Chemically Synthesized
gcugacuucauggaaugga

SEQ ID NO: 4748 - RNA, 19 nt, artificial
  Chemically Synthesized
ggcgcuuuguuuuguucgg

SEQ ID NO: 4749 - RNA, 19 nt, artificial
  Chemically Synthesized
agacgucaaacguaaacag

SEQ ID NO: 4750 - RNA, 19 nt, artificial
  Chemically Synthesized
agaugccaauuauuguuac

SEQ ID NO: 4751 - RNA, 19 nt, artificial
  Chemically Synthesized
aaaugcuguguuggguaga

SEQ ID NO: 4752 - RNA, 19 nt, artificial
  Chemically Synthesized
guggcauguuuugugcauu

SEQ ID NO: 4753 - RNA, 19 nt, artificial
  Chemically Synthesized
ccaaaguggcauguuuugu

SEQ ID NO: 4754 - RNA, 19 nt, artificial
  Chemically Synthesized
cauuugaaguguaccugug

SEQ ID NO: 4755 - RNA, 19 nt, artificial
  Chemically Synthesized
gaaaaaccauuugaagugu

SEQ ID NO: 4756 - RNA, 19 nt, artificial
  Chemically Synthesized
aggaagguucauguagaga

SEQ ID NO: 4757 - RNA, 19 nt, artificial
  Chemically Synthesized
ucacuucgggcuguguaaa

SEQ ID NO: 4758 - RNA, 19 nt, artificial
  Chemically Synthesized
gagaaagaugucaaacgug

SEQ ID NO: 4759 - RNA, 19 nt, artificial
  Chemically Synthesized
cuuugauuuacagcaagua

SEQ ID NO: 4760 - RNA, 19 nt, artificial
  Chemically Synthesized
uugcuuugauuuacagcaa

SEQ ID NO: 4761 - RNA, 19 nt, artificial
  Chemically Synthesized
cuaaaagcguuggauguag

SEQ ID NO: 4762 - RNA, 19 nt, artificial
  Chemically Synthesized
gacuucauggaauggacau

SEQ ID NO: 4763 - RNA, 19 nt, artificial
  Chemically Synthesized
agagacauggaagaggcga

SEQ ID NO: 4764 - RNA, 19 nt, artificial
  Chemically Synthesized
caaaguggcauguuuugug

SEQ ID NO: 4765 - RNA, 19 nt, artificial
  Chemically Synthesized
agccaaaguggcauguuuu

SEQ ID NO: 4766 - RNA, 19 nt, artificial
  Chemically Synthesized
ugcauguggcuuuuuuaaa

SEQ ID NO: 4767 - RNA, 19 nt, artificial
  Chemically Synthesized
ucuaaaagcguuggaugua

SEQ ID NO: 4768 - RNA, 19 nt, artificial
  Chemically Synthesized
gccucuaaaagcguuggau

SEQ ID NO: 4769 - RNA, 19 nt, artificial
  Chemically Synthesized
aggcacucuuaaaugaucu

SEQ ID NO: 4770 - RNA, 19 nt, artificial
  Chemically Synthesized
gcgcuuuguuuuguucggu

SEQ ID NO: 4771 - RNA, 19 nt, artificial
  Chemically Synthesized
uacaucacugcuugaugaa

SEQ ID NO: 4772 - RNA, 19 nt, artificial
  Chemically Synthesized
auacaucacugcuugauga

SEQ ID NO: 4773 - RNA, 19 nt, artificial
  Chemically Synthesized
aacagcucgaauuaagaau

SEQ ID NO: 4774 - RNA, 19 nt, artificial
  Chemically Synthesized
cgcaggaauaaggaagcga

SEQ ID NO: 4775 - RNA, 19 nt, artificial
  Chemically Synthesized
aguccauuugaucagcgga

SEQ ID NO: 4776 - RNA, 19 nt, artificial
  Chemically Synthesized
cgccaguccauuugaucag

SEQ ID NO: 4777 - RNA, 19 nt, artificial
  Chemically Synthesized
uucgauuuucagaaucaca

SEQ ID NO: 4778 - RNA, 19 nt, artificial
  Chemically Synthesized
agaagcacugcagagacau

SEQ ID NO: 4779 - RNA, 19 nt, artificial
  Chemically Synthesized
uugcauacugagccaagua

SEQ ID NO: 4780 - RNA, 19 nt, artificial
  Chemically Synthesized
cauuuguaaaugcuguguu

SEQ ID NO: 4781 - RNA, 19 nt, artificial
  Chemically Synthesized
acuuggagaagcacugcag

SEQ ID NO: 4782 - RNA, 19 nt, artificial
  Chemically Synthesized
gacaauauacaagccaaag

SEQ ID NO: 4783 - RNA, 19 nt, artificial
  Chemically Synthesized
ggaaaaaccauuugaagug

SEQ ID NO: 4784 - RNA, 19 nt, artificial
  Chemically Synthesized
uguguauggaaaaaccauu

SEQ ID NO: 4785 - RNA, 19 nt, artificial
  Chemically Synthesized
gccuguguauggaaaaacc

SEQ ID NO: 4786 - RNA, 19 nt, artificial
  Chemically Synthesized
agaaaagcacacuuguagg

SEQ ID NO: 4787 - RNA, 19 nt, artificial
  Chemically Synthesized
cacaggaaaguguuauuuu

SEQ ID NO: 4788 - RNA, 19 nt, artificial
  Chemically Synthesized
uccacaggaaaguguuauu

SEQ ID NO: 4789 - RNA, 19 nt, artificial
  Chemically Synthesized
uugaccaucugcuuuuauu

SEQ ID NO: 4790 - RNA, 19 nt, artificial
  Chemically Synthesized
cuugggaguuuugaauguu

SEQ ID NO: 4791 - RNA, 19 nt, artificial
  Chemically Synthesized
uuuuugagagugcgagaga

SEQ ID NO: 4792 - RNA, 19 nt, artificial
  Chemically Synthesized
gaagagaagcaauuuuggg

SEQ ID NO: 4793 - RNA, 19 nt, artificial
  Chemically Synthesized
agcuugcuuugauuuacag

SEQ ID NO: 4794 - RNA, 19 nt, artificial
  Chemically Synthesized
guucgguuuuguuuuuuug

SEQ ID NO: 4795 - RNA, 19 nt, artificial
  Chemically Synthesized
aacguaaacagcucgaauu

SEQ ID NO: 4796 - RNA, 19 nt, artificial
  Chemically Synthesized
ucagaagacgucaaacgua

SEQ ID NO: 4797 - RNA, 19 nt, artificial
  Chemically Synthesized
accugcaaccgacgauucu

SEQ ID NO: 4798 - RNA, 19 nt, artificial
  Chemically Synthesized
agcuugcccgaguucuacu

SEQ ID NO: 4799 - RNA, 19 nt, artificial
  Chemically Synthesized
ucccuuccaccgccauauu

SEQ ID NO: 4800 - RNA, 19 nt, artificial
  Chemically Synthesized
ugugaaaaagaugccaauu

SEQ ID NO: 4801 - RNA, 19 nt, artificial
  Chemically Synthesized
augugugaaaaagaugcca

SEQ ID NO: 4802 - RNA, 19 nt, artificial
  Chemically Synthesized
cuuaaaagguugcauacug

SEQ ID NO: 4803 - RNA, 19 nt, artificial
  Chemically Synthesized
uguaaaugcuguguugggu

SEQ ID NO: 4804 - RNA, 19 nt, artificial
  Chemically Synthesized
acaauauacaagccaaagu

SEQ ID NO: 4805 - RNA, 19 nt, artificial
  Chemically Synthesized
gaagaguuaacccgggacu

SEQ ID NO: 4806 - RNA, 19 nt, artificial
  Chemically Synthesized
gaggugcuugggaguuuug

SEQ ID NO: 4807 - RNA, 19 nt, artificial
  Chemically Synthesized
gcagaauggugaucacucc

SEQ ID NO: 4808 - RNA, 19 nt, artificial
  Chemically Synthesized
agcugcauguggcuuuuuu

SEQ ID NO: 4809 - RNA, 19 nt, artificial
  Chemically Synthesized
acaaaaauuugaacacugg

SEQ ID NO: 4810 - RNA, 19 nt, artificial
  Chemically Synthesized
ccuuucagagacagcugau

SEQ ID NO: 4811 - RNA, 19 nt, artificial
  Chemically Synthesized
agagcuugcuuugauuuac

SEQ ID NO: 4812 - RNA, 19 nt, artificial
  Chemically Synthesized
gguuuuguuuuuuugagag

SEQ ID NO: 4813 - RNA, 19 nt, artificial
  Chemically Synthesized
uuguacuaccuguguauau

SEQ ID NO: 4814 - RNA, 19 nt, artificial
  Chemically Synthesized
uguuuuguucgguuuuguu

SEQ ID NO: 4815 - RNA, 19 nt, artificial
  Chemically Synthesized
uuaggcacucuuaaaugau

SEQ ID NO: 4816 - RNA, 19 nt, artificial
  Chemically Synthesized
guuuaucagauacaucacu

SEQ ID NO: 4817 - RNA, 19 nt, artificial
  Chemically Synthesized
uccuuguuuaucagauaca

SEQ ID NO: 4818 - RNA, 19 nt, artificial
  Chemically Synthesized
caguccauuugaucagcgg

SEQ ID NO: 4819 - RNA, 19 nt, artificial
  Chemically Synthesized
guaaugugugaaaaagaug

SEQ ID NO: 4820 - RNA, 19 nt, artificial
  Chemically Synthesized
augcuuaaaagguugcaua

SEQ ID NO: 4821 - RNA, 19 nt, artificial
  Chemically Synthesized
uauacaagccaaaguggca

SEQ ID NO: 4822 - RNA, 19 nt, artificial
  Chemically Synthesized
ugaaguguaccuguguaca

SEQ ID NO: 4823 - RNA, 19 nt, artificial
  Chemically Synthesized
cuuacucuguccauuuauc

SEQ ID NO: 4824 - RNA, 19 nt, artificial
  Chemically Synthesized
aaccuauccucacugcccu

SEQ ID NO: 4825 - RNA, 19 nt, artificial
  Chemically Synthesized
gcaacagaaaccuauccuc

SEQ ID NO: 4826 - RNA, 19 nt, artificial
  Chemically Synthesized
acccgggagaaagauguca

SEQ ID NO: 4827 - RNA, 19 nt, artificial
  Chemically Synthesized
caaaaauuugaacacuggc

SEQ ID NO: 4828 - RNA, 19 nt, artificial
  Chemically Synthesized
aaagauguaaugucccuuu

SEQ ID NO: 4829 - RNA, 19 nt, artificial
  Chemically Synthesized
auauuugacuugcaugaag

SEQ ID NO: 4830 - RNA, 19 nt, artificial
  Chemically Synthesized
uaugaagagcuugcuuuga

SEQ ID NO: 4831 - RNA, 19 nt, artificial
  Chemically Synthesized
cuaaaauuuuaggcacucu

SEQ ID NO: 4832 - RNA, 19 nt, artificial
  Chemically Synthesized
agcacugaaaaacaacaac

SEQ ID NO: 4833 - RNA, 19 nt, artificial
  Chemically Synthesized
uggaauggacauccuguau

SEQ ID NO: 4834 - RNA, 19 nt, artificial
  Chemically Synthesized
cucagaagacgucaaacgu

SEQ ID NO: 4835 - RNA, 19 nt, artificial
  Chemically Synthesized
uugcccgaguucuacuaca

SEQ ID NO: 4836 - RNA, 19 nt, artificial
  Chemically Synthesized
uaaaagguugcauacugag

SEQ ID NO: 4837 - RNA, 19 nt, artificial
  Chemically Synthesized
auuuguaaaugcuguguug

SEQ ID NO: 4838 - RNA, 19 nt, artificial
  Chemically Synthesized
auuugaaguguaccugugu

SEQ ID NO: 4839 - RNA, 19 nt, artificial
  Chemically Synthesized
uauuucauugccuguguau

SEQ ID NO: 4840 - RNA, 19 nt, artificial
  Chemically Synthesized
cuguaaguaacuucacauu

SEQ ID NO: 4841 - RNA, 19 nt, artificial
  Chemically Synthesized
ggugaucucccaagcuauc

SEQ ID NO: 4842 - RNA, 19 nt, artificial
  Chemically Synthesized
cuuuaaagauguaaugucc

SEQ ID NO: 4843 - RNA, 19 nt, artificial
  Chemically Synthesized
aucacugcuugaugaagca

SEQ ID NO: 4844 - RNA, 19 nt, artificial
  Chemically Synthesized
uguuuaucagauacaucac

SEQ ID NO: 4845 - RNA, 19 nt, artificial
  Chemically Synthesized
cgucaaacguaaacagcuc

SEQ ID NO: 4846 - RNA, 19 nt, artificial
  Chemically Synthesized
uaaggaagcgaccugcaac

SEQ ID NO: 4847 - RNA, 19 nt, artificial
  Chemically Synthesized
uguccauuuauccacagga

SEQ ID NO: 4848 - RNA, 19 nt, artificial
  Chemically Synthesized
auugggccacuaaaaaaag

SEQ ID NO: 4849 - RNA, 19 nt, artificial
  Chemically Synthesized
uaagaauugaccaucugcu

SEQ ID NO: 4850 - RNA, 19 nt, artificial
  Chemically Synthesized
guuagauagcugcaugugg

SEQ ID NO: 4851 - RNA, 19 nt, artificial
  Chemically Synthesized
cucccaagcuaucuaaagu

SEQ ID NO: 4852 - RNA, 19 nt, artificial
  Chemically Synthesized
auuugacuugcaugaagag

SEQ ID NO: 4853 - RNA, 19 nt, artificial
  Chemically Synthesized
uaccuuuuauguagcacau

SEQ ID NO: 4854 - RNA, 19 nt, artificial
  Chemically Synthesized
auuguacuaccuguguaua

SEQ ID NO: 4855 - RNA, 19 nt, artificial
  Chemically Synthesized
uagcauuaugcaauuaggu

SEQ ID NO: 4856 - RNA, 19 nt, artificial
  Chemically Synthesized
gaucugccucuaaaagcgu

SEQ ID NO: 4857 - RNA, 19 nt, artificial
  Chemically Synthesized
auacauaucgcugacuuca

SEQ ID NO: 4858 - RNA, 19 nt, artificial
  Chemically Synthesized
aaaugccgguucuguggag

SEQ ID NO: 4859 - RNA, 19 nt, artificial
  Chemically Synthesized
acucugaggacacgcauuu

SEQ ID NO: 4860 - RNA, 19 nt, artificial
  Chemically Synthesized
caaguacgaguggcaagag

SEQ ID NO: 4861 - RNA, 19 nt, artificial
  Chemically Synthesized
gauuuucagaaucacaaac

SEQ ID NO: 4862 - RNA, 19 nt, artificial
  Chemically Synthesized
uguguacauaacucuguaa

SEQ ID NO: 4863 - RNA, 19 nt, artificial
  Chemically Synthesized
aagaguuaacccgggacuu

SEQ ID NO: 4864 - RNA, 19 nt, artificial
  Chemically Synthesized
augucaaacgugcgagugu

SEQ ID NO: 4865 - RNA, 19 nt, artificial
  Chemically Synthesized
gaucacuccagguaguuug

SEQ ID NO: 4866 - RNA, 19 nt, artificial
  Chemically Synthesized
agaaagaugucaaacgugc

SEQ ID NO: 4867 - RNA, 19 nt, artificial
  Chemically Synthesized
auagcugcauguggcuuuu

SEQ ID NO: 4868 - RNA, 19 nt, artificial
  Chemically Synthesized
uuuugagagugcgagagag

SEQ ID NO: 4869 - RNA, 19 nt, artificial
  Chemically Synthesized
ggcacucuuaaaugaucug

SEQ ID NO: 4870 - RNA, 19 nt, artificial
  Chemically Synthesized
auaucgcugacuucaugga

SEQ ID NO: 4871 - RNA, 19 nt, artificial
  Chemically Synthesized
aaaaauacauaucgcugac

SEQ ID NO: 4872 - RNA, 19 nt, artificial
  Chemically Synthesized
ugcaaccgacgauucuucu

SEQ ID NO: 4873 - RNA, 19 nt, artificial
  Chemically Synthesized
caggaauaaggaagcgacc

SEQ ID NO: 4874 - RNA, 19 nt, artificial
  Chemically Synthesized
uacugagccaaguauaauu

SEQ ID NO: 4875 - RNA, 19 nt, artificial
  Chemically Synthesized
aaaaccauuugaaguguac

SEQ ID NO: 4876 - RNA, 19 nt, artificial
  Chemically Synthesized
aaacaguauuucauugccu

SEQ ID NO: 4877 - RNA, 19 nt, artificial
  Chemically Synthesized
uuauccacaggaaaguguu

SEQ ID NO: 4878 - RNA, 19 nt, artificial
  Chemically Synthesized
uucgggcuguguaaacaca

SEQ ID NO: 4879 - RNA, 19 nt, artificial
  Chemically Synthesized
caaaaauccgaggugcuug

SEQ ID NO: 4880 - RNA, 19 nt, artificial
  Chemically Synthesized
ucucucuuaaaguuggaau

SEQ ID NO: 4881 - RNA, 19 nt, artificial
  Chemically Synthesized
cuugcuuugauuuacagca

SEQ ID NO: 4882 - RNA, 19 nt, artificial
  Chemically Synthesized
uccuuauuugcuucauugu

SEQ ID NO: 4883 - RNA, 19 nt, artificial
  Chemically Synthesized
aaagcguuggauguagcau

SEQ ID NO: 4884 - RNA, 19 nt, artificial
  Chemically Synthesized
gacauccuguauaagcacu

SEQ ID NO: 4885 - RNA, 19 nt, artificial
  Chemically Synthesized
ugugucuuuuggcuccgag

SEQ ID NO: 4886 - RNA, 19 nt, artificial
  Chemically Synthesized
gaagaaaauguuucagacg

SEQ ID NO: 4887 - RNA, 19 nt, artificial
  Chemically Synthesized
uccauuugaucagcggaga

SEQ ID NO: 4888 - RNA, 19 nt, artificial
  Chemically Synthesized
cccgaguucuacuacagac

SEQ ID NO: 4889 - RNA, 19 nt, artificial
  Chemically Synthesized
acugagccaaguauaauuu

SEQ ID NO: 4890 - RNA, 19 nt, artificial
  Chemically Synthesized
accuguguacauaacucug

SEQ ID NO: 4891 - RNA, 19 nt, artificial
  Chemically Synthesized
guagagaaaagcacacuug

SEQ ID NO: 4892 - RNA, 19 nt, artificial
  Chemically Synthesized
uuuaaaggaagguucaugu

SEQ ID NO: 4893 - RNA, 19 nt, artificial
  Chemically Synthesized
ucuaaaucccucgauauuu

SEQ ID NO: 4894 - RNA, 19 nt, artificial
  Chemically Synthesized
uuucacuucgggcugugua

SEQ ID NO: 4895 - RNA, 19 nt, artificial
  Chemically Synthesized
aaguuggaauuuaccaguu

SEQ ID NO: 4896 - RNA, 19 nt, artificial
  Chemically Synthesized
accuuuuauguagcacaua

SEQ ID NO: 4897 - RNA, 19 nt, artificial
  Chemically Synthesized
guuuuguucgguuuuguuu

SEQ ID NO: 4898 - RNA, 19 nt, artificial
  Chemically Synthesized
agcucgaauuaagaauaug

SEQ ID NO: 4899 - RNA, 19 nt, artificial
  Chemically Synthesized
acgucaaacguaaacagcu

SEQ ID NO: 4900 - RNA, 19 nt, artificial
  Chemically Synthesized
cucugaggacacgcauuug

SEQ ID NO: 4901 - RNA, 19 nt, artificial
  Chemically Synthesized
gccaaaguggcauguuuug

SEQ ID NO: 4902 - RNA, 19 nt, artificial
  Chemically Synthesized
uuaacccgggacuuggaga

SEQ ID NO: 4903 - RNA, 19 nt, artificial
  Chemically Synthesized
uucauugccuguguaugga

SEQ ID NO: 4904 - RNA, 19 nt, artificial
  Chemically Synthesized
uggaccacgaagaguuaac

SEQ ID NO: 4905 - RNA, 19 nt, artificial
  Chemically Synthesized
aaaguuggaauuuaccagu

SEQ ID NO: 4906 - RNA, 19 nt, artificial
  Chemically Synthesized
uuguuagauagcugcaugu

SEQ ID NO: 4907 - RNA, 19 nt, artificial
  Chemically Synthesized
aaaguuuguuagauagcug

SEQ ID NO: 4908 - RNA, 19 nt, artificial
  Chemically Synthesized
uuggauguagcauuaugca

SEQ ID NO: 4909 - RNA, 19 nt, artificial
  Chemically Synthesized
ucauggaauggacauccug

SEQ ID NO: 4910 - RNA, 19 nt, artificial
  Chemically Synthesized
cuuguuuaucagauacauc

SEQ ID NO: 4911 - RNA, 19 nt, artificial
  Chemically Synthesized
aagacgucaaacguaaaca

SEQ ID NO: 4912 - RNA, 19 nt, artificial
  Chemically Synthesized
gaagacgucaaacguaaac

SEQ ID NO: 4913 - RNA, 19 nt, artificial
  Chemically Synthesized
caaccgacgauucuucuac

SEQ ID NO: 4914 - RNA, 19 nt, artificial
  Chemically Synthesized
aaguacgaguggcaagagg

SEQ ID NO: 4915 - RNA, 19 nt, artificial
  Chemically Synthesized
uggaaaaaccauuugaagu

SEQ ID NO: 4916 - RNA, 19 nt, artificial
  Chemically Synthesized
gauaagugaaauggauacu

SEQ ID NO: 4917 - RNA, 19 nt, artificial
  Chemically Synthesized
agcacacuuguaggauaag

SEQ ID NO: 4918 - RNA, 19 nt, artificial
  Chemically Synthesized
aaacgugcgagugucuaac

SEQ ID NO: 4919 - RNA, 19 nt, artificial
  Chemically Synthesized
uacucagcagaauggugau

SEQ ID NO: 4920 - RNA, 19 nt, artificial
  Chemically Synthesized
aaugaucugccucuaaaag

SEQ ID NO: 4921 - RNA, 19 nt, artificial
  Chemically Synthesized
ucuguuggcucuuuuguuu

SEQ ID NO: 4922 - RNA, 19 nt, artificial
  Chemically Synthesized
uuugacaucuuucucccgg

SEQ ID NO: 4923 - RNA, 19 nt, artificial
  Chemically Synthesized
uuuuaguggcccaauaugg

SEQ ID NO: 4924 - RNA, 19 nt, artificial
  Chemically Synthesized
uguuggcucuuuuguuuug

SEQ ID NO: 4925 - RNA, 19 nt, artificial
  Chemically Synthesized
uucaaaacucccaagcacc

SEQ ID NO: 4926 - RNA, 19 nt, artificial
  Chemically Synthesized
uaacucuucgugguccacc

SEQ ID NO: 4927 - RNA, 19 nt, artificial
  Chemically Synthesized
uucuguuggcucuuuuguu

SEQ ID NO: 4928 - RNA, 19 nt, artificial
  Chemically Synthesized
uuuuaaaaaagccacaugc

SEQ ID NO: 4929 - RNA, 19 nt, artificial
  Chemically Synthesized
uuuucagugcuuauacagg

SEQ ID NO: 4930 - RNA, 19 nt, artificial
  Chemically Synthesized
uuuucuucuguucuguugg

SEQ ID NO: 4931 - RNA, 19 nt, artificial
  Chemically Synthesized
uuuggguccaccaaaugcg

SEQ ID NO: 4932 - RNA, 19 nt, artificial
  Chemically Synthesized
uuuuagaggcagaucauuu

SEQ ID NO: 4933 - RNA, 19 nt, artificial
  Chemically Synthesized
uuuuuaguggcccaauaug

SEQ ID NO: 4934 - RNA, 19 nt, artificial
  Chemically Synthesized
uuugugauucugaaaaucg

SEQ ID NO: 4935 - RNA, 19 nt, artificial
  Chemically Synthesized
uuuuucagugcuuauacag

SEQ ID NO: 4936 - RNA, 19 nt, artificial
  Chemically Synthesized
cuguuggcucuuuuguuuu

SEQ ID NO: 4937 - RNA, 19 nt, artificial
  Chemically Synthesized
uuaacauucaaaacuccca

SEQ ID NO: 4938 - RNA, 19 nt, artificial
  Chemically Synthesized
uuuccauacacaggcaaug

SEQ ID NO: 4939 - RNA, 19 nt, artificial
  Chemically Synthesized
guuggcucuuuuguuuuga

SEQ ID NO: 4940 - RNA, 19 nt, artificial
  Chemically Synthesized
auuggcaucuuuuucacac

SEQ ID NO: 4941 - RNA, 19 nt, artificial
  Chemically Synthesized
uacaaaugcacaaaacaug

SEQ ID NO: 4942 - RNA, 19 nt, artificial
  Chemically Synthesized
uguaguauccauuucacuu

SEQ ID NO: 4943 - RNA, 19 nt, artificial
  Chemically Synthesized
uugacaucuuucucccggg

SEQ ID NO: 4944 - RNA, 19 nt, artificial
  Chemically Synthesized
uuacguuugacgucuucug

SEQ ID NO: 4945 - RNA, 19 nt, artificial
  Chemically Synthesized
uuugacuguguuuacacag

SEQ ID NO: 4946 - RNA, 19 nt, artificial
  Chemically Synthesized
uucugcugaguaauuaacu

SEQ ID NO: 4947 - RNA, 19 nt, artificial
  Chemically Synthesized
uuaauucgagcuguuuacg

SEQ ID NO: 4948 - RNA, 19 nt, artificial
  Chemically Synthesized
uuuaguggcccaauauggc

SEQ ID NO: 4949 - RNA, 19 nt, artificial
  Chemically Synthesized
uccauuucacuuauccuac

SEQ ID NO: 4950 - RNA, 19 nt, artificial
  Chemically Synthesized
uuucacuuauccuacaagu

SEQ ID NO: 4951 - RNA, 19 nt, artificial
  Chemically Synthesized
uccuuauuccugcgcauug

SEQ ID NO: 4952 - RNA, 19 nt, artificial
  Chemically Synthesized
uucugaaaaucgaaauucc

SEQ ID NO: 4953 - RNA, 19 nt, artificial
  Chemically Synthesized
uuauacuuggcucaguaug

SEQ ID NO: 4954 - RNA, 19 nt, artificial
  Chemically Synthesized
uauucuacccaacacagca

SEQ ID NO: 4955 - RNA, 19 nt, artificial
  Chemically Synthesized
ucugcagugcuucuccaag

SEQ ID NO: 4956 - RNA, 19 nt, artificial
  Chemically Synthesized
aaaacucccaagcaccucg

SEQ ID NO: 4957 - RNA, 19 nt, artificial
  Chemically Synthesized
uuguguuguuguuuuucag

SEQ ID NO: 4958 - RNA, 19 nt, artificial
  Chemically Synthesized
auguaucugauaaacaagg

SEQ ID NO: 4959 - RNA, 19 nt, artificial
  Chemically Synthesized
ucgagggauuuagaauuau

SEQ ID NO: 4960 - RNA, 19 nt, artificial
  Chemically Synthesized
uuaugugcuacauaaaagg

SEQ ID NO: 4961 - RNA, 19 nt, artificial
  Chemically Synthesized
uuuacguuugacgucuucu

SEQ ID NO: 4962 - RNA, 19 nt, artificial
  Chemically Synthesized
ugaaaaucgaaauuccacu

SEQ ID NO: 4963 - RNA, 19 nt, artificial
  Chemically Synthesized
auguguaacaauaauuggc

SEQ ID NO: 4964 - RNA, 19 nt, artificial
  Chemically Synthesized
uaaaaaagccacaugcagc

SEQ ID NO: 4965 - RNA, 19 nt, artificial
  Chemically Synthesized
uguuuuucagugcuuauac

SEQ ID NO: 4966 - RNA, 19 nt, artificial
  Chemically Synthesized
uuuggcuuguauauugucu

SEQ ID NO: 4967 - RNA, 19 nt, artificial
  Chemically Synthesized
uuucaguguuuuuacagag

SEQ ID NO: 4968 - RNA, 19 nt, artificial
  Chemically Synthesized
uacaagugugcuuuucucu

SEQ ID NO: 4969 - RNA, 19 nt, artificial
  Chemically Synthesized
auugcauaaugcuacaucc

SEQ ID NO: 4970 - RNA, 19 nt, artificial
  Chemically Synthesized
uuucagugcuuauacagga

SEQ ID NO: 4971 - RNA, 19 nt, artificial
  Chemically Synthesized
aucgaaauuccacuugcgc

SEQ ID NO: 4972 - RNA, 19 nt, artificial
  Chemically Synthesized
uuaguggcccaauauggcg

SEQ ID NO: 4973 - RNA, 19 nt, artificial
  Chemically Synthesized
cuuaacauucaaaacuccc

SEQ ID NO: 4974 - RNA, 19 nt, artificial
  Chemically Synthesized
ucgaaauuccacuugcgcu

SEQ ID NO: 4975 - RNA, 19 nt, artificial
  Chemically Synthesized
ugugcuuuucucuacauga

SEQ ID NO: 4976 - RNA, 19 nt, artificial
  Chemically Synthesized
uuagccaguguucaaauuu

SEQ ID NO: 4977 - RNA, 19 nt, artificial
  Chemically Synthesized
ucucaaaaaaacaaaaccg

SEQ ID NO: 4978 - RNA, 19 nt, artificial
  Chemically Synthesized
ucuucuguucuguuggcuc

SEQ ID NO: 4979 - RNA, 19 nt, artificial
  Chemically Synthesized
uauccauuucacuuauccu

SEQ ID NO: 4980 - RNA, 19 nt, artificial
  Chemically Synthesized
aagaaaacaauucaaaccc

SEQ ID NO: 4981 - RNA, 19 nt, artificial
  Chemically Synthesized
acagguaguacaaugaagc

SEQ ID NO: 4982 - RNA, 19 nt, artificial
  Chemically Synthesized
uaaggaaaaaccuaauugc

SEQ ID NO: 4983 - RNA, 19 nt, artificial
  Chemically Synthesized
uucuccaccucuugccacu

SEQ ID NO: 4984 - RNA, 19 nt, artificial
  Chemically Synthesized
uauacuuggcucaguaugc

SEQ ID NO: 4985 - RNA, 19 nt, artificial
  Chemically Synthesized
uuggcuuguauauugucua

SEQ ID NO: 4986 - RNA, 19 nt, artificial
  Chemically Synthesized
uuuuuuuaguggcccaaua

SEQ ID NO: 4987 - RNA, 19 nt, artificial
  Chemically Synthesized
ucccaaaugagaauaaacu

SEQ ID NO: 4988 - RNA, 19 nt, artificial
  Chemically Synthesized
auacacagguaguacaaug

SEQ ID NO: 4989 - RNA, 19 nt, artificial
  Chemically Synthesized
uacaaugaagcaaauaagg

SEQ ID NO: 4990 - RNA, 19 nt, artificial
  Chemically Synthesized
aucaaauggacuggcgagc

SEQ ID NO: 4991 - RNA, 19 nt, artificial
  Chemically Synthesized
uuauguacacagguacacu

SEQ ID NO: 4992 - RNA, 19 nt, artificial
  Chemically Synthesized
ucuuuaaaaauaucgaggg

SEQ ID NO: 4993 - RNA, 19 nt, artificial
  Chemically Synthesized
uaauaaaagcagaugguca

SEQ ID NO: 4994 - RNA, 19 nt, artificial
  Chemically Synthesized
uuuuuuaguggcccaauau

SEQ ID NO: 4995 - RNA, 19 nt, artificial
  Chemically Synthesized
uacagaguuauguacacag

SEQ ID NO: 4996 - RNA, 19 nt, artificial
  Chemically Synthesized
uggucaauucuuaacauuc

SEQ ID NO: 4997 - RNA, 19 nt, artificial
  Chemically Synthesized
auuaucuuuagccaguguu

SEQ ID NO: 4998 - RNA, 19 nt, artificial
  Chemically Synthesized
aagcaaauaaggaaaaacc

SEQ ID NO: 4999 - RNA, 19 nt, artificial
  Chemically Synthesized
uguuguuguuuuucagugc

SEQ ID NO: 5000 - RNA, 19 nt, artificial
  Chemically Synthesized
uuugacgucuucugaggcc

SEQ ID NO: 5001 - RNA, 19 nt, artificial
  Chemically Synthesized
guucuguuggcucuuuugu

SEQ ID NO: 5002 - RNA, 19 nt, artificial
  Chemically Synthesized
aagcaagcucuucauaccc

SEQ ID NO: 5003 - RNA, 19 nt, artificial
  Chemically Synthesized
uucuguucuguuggcucuu

SEQ ID NO: 5004 - RNA, 19 nt, artificial
  Chemically Synthesized
acaaaugcacaaaacaugc

SEQ ID NO: 5005 - RNA, 19 nt, artificial
  Chemically Synthesized
uguggauaaauggacagag

SEQ ID NO: 5006 - RNA, 19 nt, artificial
  Chemically Synthesized
ugaaguuacuuacagaucu

SEQ ID NO: 5007 - RNA, 19 nt, artificial
  Chemically Synthesized
ugacuguguuuacacagcc

SEQ ID NO: 5008 - RNA, 19 nt, artificial
  Chemically Synthesized
uguuuugaguagaagaauc

SEQ ID NO: 5009 - RNA, 19 nt, artificial
  Chemically Synthesized
ucuuccaugucucugcagu

SEQ ID NO: 5010 - RNA, 19 nt, artificial
  Chemically Synthesized
ucugcugaguaauuaacug

SEQ ID NO: 5011 - RNA, 19 nt, artificial
  Chemically Synthesized
ugaaagggacauuacaucu

SEQ ID NO: 5012 - RNA, 19 nt, artificial
  Chemically Synthesized
aauugcauaaugcuacauc

SEQ ID NO: 5013 - RNA, 19 nt, artificial
  Chemically Synthesized
uguguuguuguuuuucagu

SEQ ID NO: 5014 - RNA, 19 nt, artificial
  Chemically Synthesized
auucgagcuguuuacguuu

SEQ ID NO: 5015 - RNA, 19 nt, artificial
  Chemically Synthesized
uuuugaguagaagaaucgu

SEQ ID NO: 5016 - RNA, 19 nt, artificial
  Chemically Synthesized
uagaagaaucgucgguugc

SEQ ID NO: 5017 - RNA, 19 nt, artificial
  Chemically Synthesized
uuccuuauuccugcgcauu

SEQ ID NO: 5018 - RNA, 19 nt, artificial
  Chemically Synthesized
uguguaacaauaauuggca

SEQ ID NO: 5019 - RNA, 19 nt, artificial
  Chemically Synthesized
uguaacaauaauuggcauc

SEQ ID NO: 5020 - RNA, 19 nt, artificial
  Chemically Synthesized
uauguacacagguacacuu

SEQ ID NO: 5021 - RNA, 19 nt, artificial
  Chemically Synthesized
auaucgagggauuuagaau

SEQ ID NO: 5022 - RNA, 19 nt, artificial
  Chemically Synthesized
uugacuguguuuacacagc

SEQ ID NO: 5023 - RNA, 19 nt, artificial
  Chemically Synthesized
uuaaaaaagccacaugcag

SEQ ID NO: 5024 - RNA, 19 nt, artificial
  Chemically Synthesized
augaaguaucagcugucuc

SEQ ID NO: 5025 - RNA, 19 nt, artificial
  Chemically Synthesized
ucagugcuuauacaggaug

SEQ ID NO: 5026 - RNA, 19 nt, artificial
  Chemically Synthesized
ucaagcagugauguaucug

SEQ ID NO: 5027 - RNA, 19 nt, artificial
  Chemically Synthesized
agccaaaagacacagaccc

SEQ ID NO: 5028 - RNA, 19 nt, artificial
  Chemically Synthesized
uuggcucuuuuguuuugag

SEQ ID NO: 5029 - RNA, 19 nt, artificial
  Chemically Synthesized
uccaugucucugcagugcu

SEQ ID NO: 5030 - RNA, 19 nt, artificial
  Chemically Synthesized
cgagggauuuagaauuauu

SEQ ID NO: 5031 - RNA, 19 nt, artificial
  Chemically Synthesized
acuguguuuacacagcccg

SEQ ID NO: 5032 - RNA, 19 nt, artificial
  Chemically Synthesized
auagcuugggagaucacca

SEQ ID NO: 5033 - RNA, 19 nt, artificial
  Chemically Synthesized
uugggagaucaccagaucu

SEQ ID NO: 5034 - RNA, 19 nt, artificial
  Chemically Synthesized
aaaacaauucaaacccuuc

SEQ ID NO: 5035 - RNA, 19 nt, artificial
  Chemically Synthesized
cauaaugcuacauccaacg

SEQ ID NO: 5036 - RNA, 19 nt, artificial
  Chemically Synthesized
auguauaucuuccuugcuu

SEQ ID NO: 5037 - RNA, 19 nt, artificial
  Chemically Synthesized
uugacgucuucugaggcca

SEQ ID NO: 5038 - RNA, 19 nt, artificial
  Chemically Synthesized
uugcaggucgcuuccuuau

SEQ ID NO: 5039 - RNA, 19 nt, artificial
  Chemically Synthesized
uaguagaacucgggcaagc

SEQ ID NO: 5040 - RNA, 19 nt, artificial
  Chemically Synthesized
acagguacacuucaaaugg

SEQ ID NO: 5041 - RNA, 19 nt, artificial
  Chemically Synthesized
auaaauggacagaguaagc

SEQ ID NO: 5042 - RNA, 19 nt, artificial
  Chemically Synthesized
uaacauucaaaacucccaa

SEQ ID NO: 5043 - RNA, 19 nt, artificial
  Chemically Synthesized
aucuacuugcuguaaauca

SEQ ID NO: 5044 - RNA, 19 nt, artificial
  Chemically Synthesized
uagaggcagaucauuuaag

SEQ ID NO: 5045 - RNA, 19 nt, artificial
  Chemically Synthesized
ucuguaguagaacucgggc

SEQ ID NO: 5046 - RNA, 19 nt, artificial
  Chemically Synthesized
uacccaacacagcauuuac

SEQ ID NO: 5047 - RNA, 19 nt, artificial
  Chemically Synthesized
uucacuuauccuacaagug

SEQ ID NO: 5048 - RNA, 19 nt, artificial
  Chemically Synthesized
uugcauaaugcuacaucca

SEQ ID NO: 5049 - RNA, 19 nt, artificial
  Chemically Synthesized
ucugaaaaucgaaauucca

SEQ ID NO: 5050 - RNA, 19 nt, artificial
  Chemically Synthesized
uuggcaucuuuuucacaca

SEQ ID NO: 5051 - RNA, 19 nt, artificial
  Chemically Synthesized
uucuacccaacacagcauu

SEQ ID NO: 5052 - RNA, 19 nt, artificial
  Chemically Synthesized
ucaaaugguuuuuccauac

SEQ ID NO: 5053 - RNA, 19 nt, artificial
  Chemically Synthesized
augguuuuuccauacacag

SEQ ID NO: 5054 - RNA, 19 nt, artificial
  Chemically Synthesized
uuccauacacaggcaauga

SEQ ID NO: 5055 - RNA, 19 nt, artificial
  Chemically Synthesized
auuucacuuauccuacaag

SEQ ID NO: 5056 - RNA, 19 nt, artificial
  Chemically Synthesized
ugcuuuucucuacaugaac

SEQ ID NO: 5057 - RNA, 19 nt, artificial
  Chemically Synthesized
aaaauaucgagggauuuag

SEQ ID NO: 5058 - RNA, 19 nt, artificial
  Chemically Synthesized
auuuugacuguguuuacac

SEQ ID NO: 5059 - RNA, 19 nt, artificial
  Chemically Synthesized
acauucaaaacucccaagc

SEQ ID NO: 5060 - RNA, 19 nt, artificial
  Chemically Synthesized
auucaaaacucccaagcac

SEQ ID NO: 5061 - RNA, 19 nt, artificial
  Chemically Synthesized
ucaaaacucccaagcaccu

SEQ ID NO: 5062 - RNA, 19 nt, artificial
  Chemically Synthesized
aaccgaacaaaacaaagcg

SEQ ID NO: 5063 - RNA, 19 nt, artificial
  Chemically Synthesized
uauaucuuccuugcuucau

SEQ ID NO: 5064 - RNA, 19 nt, artificial
  Chemically Synthesized
cuguucuguuggcucuuuu

SEQ ID NO: 5065 - RNA, 19 nt, artificial
  Chemically Synthesized
gucgcuuccuuauuccugc

SEQ ID NO: 5066 - RNA, 19 nt, artificial
  Chemically Synthesized
uaauuggcaucuuuuucac

SEQ ID NO: 5067 - RNA, 19 nt, artificial
  Chemically Synthesized
uuacacagcccgaagugaa

SEQ ID NO: 5068 - RNA, 19 nt, artificial
  Chemically Synthesized
ucuuaacauucaaaacucc

SEQ ID NO: 5069 - RNA, 19 nt, artificial
  Chemically Synthesized
uaucuacuugcuguaaauc

SEQ ID NO: 5070 - RNA, 19 nt, artificial
  Chemically Synthesized
uuguuguuuuucagugcuu

SEQ ID NO: 5071 - RNA, 19 nt, artificial
  Chemically Synthesized
ucuuuggguccaccaaaug

SEQ ID NO: 5072 - RNA, 19 nt, artificial
  Chemically Synthesized
uuuuccauacacaggcaau

SEQ ID NO: 5073 - RNA, 19 nt, artificial
  Chemically Synthesized
uuaacucuucgugguccac

SEQ ID NO: 5074 - RNA, 19 nt, artificial
  Chemically Synthesized
uaaaagcagauggucaauu

SEQ ID NO: 5075 - RNA, 19 nt, artificial
  Chemically Synthesized
uccaacuuuaagagagacu

SEQ ID NO: 5076 - RNA, 19 nt, artificial
  Chemically Synthesized
uaaaugaaguaucagcugu

SEQ ID NO: 5077 - RNA, 19 nt, artificial
  Chemically Synthesized
uacacagguaguacaauga

SEQ ID NO: 5078 - RNA, 19 nt, artificial
  Chemically Synthesized
acaggauguccauuccaug

SEQ ID NO: 5079 - RNA, 19 nt, artificial
  Chemically Synthesized
ucuuccuugcuucaucaag

SEQ ID NO: 5080 - RNA, 19 nt, artificial
  Chemically Synthesized
acauauucuuaauucgagc

SEQ ID NO: 5081 - RNA, 19 nt, artificial
  Chemically Synthesized
uucugaggccaggcuucuu

SEQ ID NO: 5082 - RNA, 19 nt, artificial
  Chemically Synthesized
aaccuuuuaagcauagcca

SEQ ID NO: 5083 - RNA, 19 nt, artificial
  Chemically Synthesized
ugguuuuuccauacacagg

SEQ ID NO: 5084 - RNA, 19 nt, artificial
  Chemically Synthesized
auguaguauccauuucacu

SEQ ID NO: 5085 - RNA, 19 nt, artificial
  Chemically Synthesized
acucgcacguuugacaucu

SEQ ID NO: 5086 - RNA, 19 nt, artificial
  Chemically Synthesized
auagguuucuguugcuuuu

SEQ ID NO: 5087 - RNA, 19 nt, artificial
  Chemically Synthesized
uagcaauuaucuuuagcca

SEQ ID NO: 5088 - RNA, 19 nt, artificial
  Chemically Synthesized
aaaauugcuucucuucaug

SEQ ID NO: 5089 - RNA, 19 nt, artificial
  Chemically Synthesized
cuuccuugcuucaucaagc

SEQ ID NO: 5090 - RNA, 19 nt, artificial
  Chemically Synthesized
gucugaaacauuuucuucu

SEQ ID NO: 5091 - RNA, 19 nt, artificial
  Chemically Synthesized
uuucuucuguucuguuggc

SEQ ID NO: 5092 - RNA, 19 nt, artificial
  Chemically Synthesized
uucuucuguucuguuggcu

SEQ ID NO: 5093 - RNA, 19 nt, artificial
  Chemically Synthesized
uccgacggaucagucuuug

SEQ ID NO: 5094 - RNA, 19 nt, artificial
  Chemically Synthesized
accaaaugcguguccucag

SEQ ID NO: 5095 - RNA, 19 nt, artificial
  Chemically Synthesized
cuuggcucaguaugcaacc

SEQ ID NO: 5096 - RNA, 19 nt, artificial
  Chemically Synthesized
uccaagucccggguuaacu

SEQ ID NO: 5097 - RNA, 19 nt, artificial
  Chemically Synthesized
guauccauuucacuuaucc

SEQ ID NO: 5098 - RNA, 19 nt, artificial
  Chemically Synthesized
uuuucucuacaugaaccuu

SEQ ID NO: 5099 - RNA, 19 nt, artificial
  Chemically Synthesized
aagcaccucggauuuuugc

SEQ ID NO: 5100 - RNA, 19 nt, artificial
  Chemically Synthesized
uagguuucuguugcuuuuu

SEQ ID NO: 5101 - RNA, 19 nt, artificial
  Chemically Synthesized
ucaccagaucucccaaaug

SEQ ID NO: 5102 - RNA, 19 nt, artificial
  Chemically Synthesized
uucucuucaugcaagucaa

SEQ ID NO: 5103 - RNA, 19 nt, artificial
  Chemically Synthesized
ucgcacucucaaaaaaaca

SEQ ID NO: 5104 - RNA, 19 nt, artificial
  Chemically Synthesized
aaaccuaauugcauaaugc

SEQ ID NO: 5105 - RNA, 19 nt, artificial
  Chemically Synthesized
aagaaucgucgguugcagg

SEQ ID NO: 5106 - RNA, 19 nt, artificial
  Chemically Synthesized
ucagucuuuggguccacca

SEQ ID NO: 5107 - RNA, 19 nt, artificial
  Chemically Synthesized
cugaaaaucgaaauuccac

SEQ ID NO: 5108 - RNA, 19 nt, artificial
  Chemically Synthesized
caaccuuuuaagcauagcc

SEQ ID NO: 5109 - RNA, 19 nt, artificial
  Chemically Synthesized
aaacaugccacuuuggcuu

SEQ ID NO: 5110 - RNA, 19 nt, artificial
  Chemically Synthesized
uuuuuccauacacaggcaa

SEQ ID NO: 5111 - RNA, 19 nt, artificial
  Chemically Synthesized
aauaucgagggauuuagaa

SEQ ID NO: 5112 - RNA, 19 nt, artificial
  Chemically Synthesized
cugcugaguaauuaacugg

SEQ ID NO: 5113 - RNA, 19 nt, artificial
  Chemically Synthesized
uuuagauagcuugggagau

SEQ ID NO: 5114 - RNA, 19 nt, artificial
  Chemically Synthesized
auaaugcuacauccaacgc

SEQ ID NO: 5115 - RNA, 19 nt, artificial
  Chemically Synthesized
aguguuauuguguuguugu

SEQ ID NO: 5116 - RNA, 19 nt, artificial
  Chemically Synthesized
uguuguuuuucagugcuua

SEQ ID NO: 5117 - RNA, 19 nt, artificial
  Chemically Synthesized
uuccaugaagucagcgaua

SEQ ID NO: 5118 - RNA, 19 nt, artificial
  Chemically Synthesized
accgucugaaacauuuucu

SEQ ID NO: 5119 - RNA, 19 nt, artificial
  Chemically Synthesized
uggcucuuuuguuuugagu

SEQ ID NO: 5120 - RNA, 19 nt, artificial
  Chemically Synthesized
guuuugaguagaagaaucg

SEQ ID NO: 5121 - RNA, 19 nt, artificial
  Chemically Synthesized
ugcguguccucagaguuag

SEQ ID NO: 5122 - RNA, 19 nt, artificial
  Chemically Synthesized
ugcagugcuucuccaaguc

SEQ ID NO: 5123 - RNA, 19 nt, artificial
  Chemically Synthesized
acaagugugcuuuucucua

SEQ ID NO: 5124 - RNA, 19 nt, artificial
  Chemically Synthesized
ugggagaucaccagaucuc

SEQ ID NO: 5125 - RNA, 19 nt, artificial
  Chemically Synthesized
aaaccgaacaaaacaaagc

SEQ ID NO: 5126 - RNA, 19 nt, artificial
  Chemically Synthesized
ugcuuauacaggaugucca

SEQ ID NO: 5127 - RNA, 19 nt, artificial
  Chemically Synthesized
uacaggauguccauuccau

SEQ ID NO: 5128 - RNA, 19 nt, artificial
  Chemically Synthesized
ucggagccaaaagacacag

SEQ ID NO: 5129 - RNA, 19 nt, artificial
  Chemically Synthesized
uucgagcuguuuacguuug

SEQ ID NO: 5130 - RNA, 19 nt, artificial
  Chemically Synthesized
aaccgucugaaacauuuuc

SEQ ID NO: 5131 - RNA, 19 nt, artificial
  Chemically Synthesized
ucugaaacauuuucuucug

SEQ ID NO: 5132 - RNA, 19 nt, artificial
  Chemically Synthesized
ugaguagaagaaucgucgg

SEQ ID NO: 5133 - RNA, 19 nt, artificial
  Chemically Synthesized
aucagucuuuggguccacc

SEQ ID NO: 5134 - RNA, 19 nt, artificial
  Chemically Synthesized
acuuggcucaguaugcaac

SEQ ID NO: 5135 - RNA, 19 nt, artificial
  Chemically Synthesized
ucucugcagugcuucucca

SEQ ID NO: 5136 - RNA, 19 nt, artificial
  Chemically Synthesized
cuuuccuguggauaaaugg

SEQ ID NO: 5137 - RNA, 19 nt, artificial
  Chemically Synthesized
uuuccuguggauaaaugga

SEQ ID NO: 5138 - RNA, 19 nt, artificial
  Chemically Synthesized
gugaucaccauucugcuga

SEQ ID NO: 5139 - RNA, 19 nt, artificial
  Chemically Synthesized
ccuaauugcauaaugcuac

SEQ ID NO: 5140 - RNA, 19 nt, artificial
  Chemically Synthesized
agugccuaaaauuuuagug

SEQ ID NO: 5141 - RNA, 19 nt, artificial
  Chemically Synthesized
gugcuuauacaggaugucc

SEQ ID NO: 5142 - RNA, 19 nt, artificial
  Chemically Synthesized
uguccgacggaucagucuu

SEQ ID NO: 5143 - RNA, 19 nt, artificial
  Chemically Synthesized
uugugauucugaaaaucga

SEQ ID NO: 5144 - RNA, 19 nt, artificial
  Chemically Synthesized
aaucgaaauuccacuugcg

SEQ ID NO: 5145 - RNA, 19 nt, artificial
  Chemically Synthesized
cucuacaugaaccuuccuu

SEQ ID NO: 5146 - RNA, 19 nt, artificial
  Chemically Synthesized
uaacacuuuccuguggaua

SEQ ID NO: 5147 - RNA, 19 nt, artificial
  Chemically Synthesized
uguuuacacagcccgaagu

SEQ ID NO: 5148 - RNA, 19 nt, artificial
  Chemically Synthesized
ucucgcacucucaaaaaaa

SEQ ID NO: 5149 - RNA, 19 nt, artificial
  Chemically Synthesized
ugcuacauccaacgcuuuu

SEQ ID NO: 5150 - RNA, 19 nt, artificial
  Chemically Synthesized
uggcucaguaugcaaccuu

SEQ ID NO: 5151 - RNA, 19 nt, artificial
  Chemically Synthesized
aaaccuauucuacccaaca

SEQ ID NO: 5152 - RNA, 19 nt, artificial
  Chemically Synthesized
accuauucuacccaacaca

SEQ ID NO: 5153 - RNA, 19 nt, artificial
  Chemically Synthesized
ucccggguuaacucuucgu

SEQ ID NO: 5154 - RNA, 19 nt, artificial
  Chemically Synthesized
ucacuuauccuacaagugu

SEQ ID NO: 5155 - RNA, 19 nt, artificial
  Chemically Synthesized
uuuugacuguguuuacaca

SEQ ID NO: 5156 - RNA, 19 nt, artificial
  Chemically Synthesized
aauuccaacuuuaagagag

SEQ ID NO: 5157 - RNA, 19 nt, artificial
  Chemically Synthesized
ugaggauagguuucuguug

SEQ ID NO: 5158 - RNA, 19 nt, artificial
  Chemically Synthesized
ugcagcuaucuaacaaacu

SEQ ID NO: 5159 - RNA, 19 nt, artificial
  Chemically Synthesized
uagccaguguucaaauuuu

SEQ ID NO: 5160 - RNA, 19 nt, artificial
  Chemically Synthesized
uaaaucaaagcaagcucuu

SEQ ID NO: 5161 - RNA, 19 nt, artificial
  Chemically Synthesized
aaugcuacauccaacgcuu

SEQ ID NO: 5162 - RNA, 19 nt, artificial
  Chemically Synthesized
aucugauaaacaaggaaac

SEQ ID NO: 5163 - RNA, 19 nt, artificial
  Chemically Synthesized
cuuuggguccaccaaaugc

SEQ ID NO: 5164 - RNA, 19 nt, artificial
  Chemically Synthesized
cuuccaugucucugcagug

SEQ ID NO: 5165 - RNA, 19 nt, artificial
  Chemically Synthesized
caugucucugcagugcuuc

SEQ ID NO: 5166 - RNA, 19 nt, artificial
  Chemically Synthesized
acagcauuuacaaaugcac

SEQ ID NO: 5167 - RNA, 19 nt, artificial
  Chemically Synthesized
auguacacagguacacuuc

SEQ ID NO: 5168 - RNA, 19 nt, artificial
  Chemically Synthesized
uacacagguacacuucaaa

SEQ ID NO: 5169 - RNA, 19 nt, artificial
  Chemically Synthesized
aucgagggauuuagaauua

SEQ ID NO: 5170 - RNA, 19 nt, artificial
  Chemically Synthesized
agauggucaauucuuaaca

SEQ ID NO: 5171 - RNA, 19 nt, artificial
  Chemically Synthesized
uggagugaucaccauucug

SEQ ID NO: 5172 - RNA, 19 nt, artificial
  Chemically Synthesized
uuuagccaguguucaaauu

SEQ ID NO: 5173 - RNA, 19 nt, artificial
  Chemically Synthesized
ucagcugucucugaaaggg

SEQ ID NO: 5174 - RNA, 19 nt, artificial
  Chemically Synthesized
ucugaaagggacauuacau

SEQ ID NO: 5175 - RNA, 19 nt, artificial
  Chemically Synthesized
uguccauuccaugaaguca

SEQ ID NO: 5176 - RNA, 19 nt, artificial
  Chemically Synthesized
auuccaugaagucagcgau

SEQ ID NO: 5177 - RNA, 19 nt, artificial
  Chemically Synthesized
cuauucuacccaacacagc

SEQ ID NO: 5178 - RNA, 19 nt, artificial
  Chemically Synthesized
acuuauccuacaagugugc

SEQ ID NO: 5179 - RNA, 19 nt, artificial
  Chemically Synthesized
aagugugcuuuucucuaca

SEQ ID NO: 5180 - RNA, 19 nt, artificial
  Chemically Synthesized
aagcagauggucaauucuu

SEQ ID NO: 5181 - RNA, 19 nt, artificial
  Chemically Synthesized
uuccaacuuuaagagagac

SEQ ID NO: 5182 - RNA, 19 nt, artificial
  Chemically Synthesized
uugcuucucuucaugcaag

SEQ ID NO: 5183 - RNA, 19 nt, artificial
  Chemically Synthesized
acauccaacgcuuuuagag

SEQ ID NO: 5184 - RNA, 19 nt, artificial
  Chemically Synthesized
uccacagaaccggcauuug

SEQ ID NO: 5185 - RNA, 19 nt, artificial
  Chemically Synthesized
augcguguccucagaguua

SEQ ID NO: 5186 - RNA, 19 nt, artificial
  Chemically Synthesized
acucguacuugcccucuag

SEQ ID NO: 5187 - RNA, 19 nt, artificial
  Chemically Synthesized
ugaucaaauggacuggcga

SEQ ID NO: 5188 - RNA, 19 nt, artificial
  Chemically Synthesized
cgaaauuccacuugcgcug

SEQ ID NO: 5189 - RNA, 19 nt, artificial
  Chemically Synthesized
uuuacagaguuauguacac

SEQ ID NO: 5190 - RNA, 19 nt, artificial
  Chemically Synthesized
aaaugguuuuuccauacac

SEQ ID NO: 5191 - RNA, 19 nt, artificial
  Chemically Synthesized
aguagaagaaucgucgguu

SEQ ID NO: 5192 - RNA, 19 nt, artificial
  Chemically Synthesized
accucuugccacucguacu

SEQ ID NO: 5193 - RNA, 19 nt, artificial
  Chemically Synthesized
aaaauuauacuuggcucag

SEQ ID NO: 5194 - RNA, 19 nt, artificial
  Chemically Synthesized
aaaugcacaaaacaugcca

SEQ ID NO: 5195 - RNA, 19 nt, artificial
  Chemically Synthesized
augcacaaaacaugccacu

SEQ ID NO: 5196 - RNA, 19 nt, artificial
  Chemically Synthesized
uucaguguuuuuacagagu

SEQ ID NO: 5197 - RNA, 19 nt, artificial
  Chemically Synthesized
guuuaaagauguaguaucc

SEQ ID NO: 5198 - RNA, 19 nt, artificial
  Chemically Synthesized
cuaccuggagugaucacca

SEQ ID NO: 5199 - RNA, 19 nt, artificial
  Chemically Synthesized
ucgcacguuugacaucuuu

SEQ ID NO: 5200 - RNA, 19 nt, artificial
  Chemically Synthesized
cguuugacaucuuucuccc

SEQ ID NO: 5201 - RNA, 19 nt, artificial
  Chemically Synthesized
augcagcuaucuaacaaac

SEQ ID NO: 5202 - RNA, 19 nt, artificial
  Chemically Synthesized
agcaauuaucuuuagccag

SEQ ID NO: 5203 - RNA, 19 nt, artificial
  Chemically Synthesized
cauccaacgcuuuuagagg

SEQ ID NO: 5204 - RNA, 19 nt, artificial
  Chemically Synthesized
guccauuccaugaagucag

SEQ ID NO: 5205 - RNA, 19 nt, artificial
  Chemically Synthesized
augaagucagcgauaugua

SEQ ID NO: 5206 - RNA, 19 nt, artificial
  Chemically Synthesized
uuggguccaccaaaugcgu

SEQ ID NO: 5207 - RNA, 19 nt, artificial
  Chemically Synthesized
uucuccaagucccggguua

SEQ ID NO: 5208 - RNA, 19 nt, artificial
  Chemically Synthesized
cgcacguuugacaucuuuc

SEQ ID NO: 5209 - RNA, 19 nt, artificial
  Chemically Synthesized
acaucuuucucccgggucu

SEQ ID NO: 5210 - RNA, 19 nt, artificial
  Chemically Synthesized
uaucagcugucucugaaag

SEQ ID NO: 5211 - RNA, 19 nt, artificial
  Chemically Synthesized
ucuacuugcuguaaaucaa

SEQ ID NO: 5212 - RNA, 19 nt, artificial
  Chemically Synthesized
ucauuuaagagugccuaaa

SEQ ID NO: 5213 - RNA, 19 nt, artificial
  Chemically Synthesized
uucagugcuuauacaggau

SEQ ID NO: 5214 - RNA, 19 nt, artificial
  Chemically Synthesized
ugcaggucgcuuccuuauu

SEQ ID NO: 5215 - RNA, 19 nt, artificial
  Chemically Synthesized
uccaccaaaugcguguccu

SEQ ID NO: 5216 - RNA, 19 nt, artificial
  Chemically Synthesized
aaugcguguccucagaguu

SEQ ID NO: 5217 - RNA, 19 nt, artificial
  Chemically Synthesized
cuuuuaagcauagccauau

SEQ ID NO: 5218 - RNA, 19 nt, artificial
  Chemically Synthesized
aaccuauucuacccaacac

SEQ ID NO: 5219 - RNA, 19 nt, artificial
  Chemically Synthesized
ucaguguuuuuacagaguu

SEQ ID NO: 5220 - RNA, 19 nt, artificial
  Chemically Synthesized
cuuuucucuacaugaaccu

SEQ ID NO: 5221 - RNA, 19 nt, artificial
  Chemically Synthesized
ccuggagugaucaccauuc

SEQ ID NO: 5222 - RNA, 19 nt, artificial
  Chemically Synthesized
ccaacuuuaagagagacug

SEQ ID NO: 5223 - RNA, 19 nt, artificial
  Chemically Synthesized
ccaaaauugcuucucuuca

SEQ ID NO: 5224 - RNA, 19 nt, artificial
  Chemically Synthesized
aacauuuucuucuguucug

SEQ ID NO: 5225 - RNA, 19 nt, artificial
  Chemically Synthesized
gucuccgcugaucaaaugg

SEQ ID NO: 5226 - RNA, 19 nt, artificial
  Chemically Synthesized
auucuacccaacacagcau

SEQ ID NO: 5227 - RNA, 19 nt, artificial
  Chemically Synthesized
agcaccucggauuuuugcc

SEQ ID NO: 5228 - RNA, 19 nt, artificial
  Chemically Synthesized
accagaucucccaaaugag

SEQ ID NO: 5229 - RNA, 19 nt, artificial
  Chemically Synthesized
caguguucaaauuuuugug

SEQ ID NO: 5230 - RNA, 19 nt, artificial
  Chemically Synthesized
acuugcuguaaaucaaagc

SEQ ID NO: 5231 - RNA, 19 nt, artificial
  Chemically Synthesized
aggcagaucauuuaagagu

SEQ ID NO: 5232 - RNA, 19 nt, artificial
  Chemically Synthesized
cuucuguucuguuggcucu

SEQ ID NO: 5233 - RNA, 19 nt, artificial
  Chemically Synthesized
ucuguucuguuggcucuuu

SEQ ID NO: 5234 - RNA, 19 nt, artificial
  Chemically Synthesized
uuggcucaguaugcaaccu

SEQ ID NO: 5235 - RNA, 19 nt, artificial
  Chemically Synthesized
aguaugcaaccuuuuaagc

SEQ ID NO: 5236 - RNA, 19 nt, artificial
  Chemically Synthesized
aaaaccuauucuacccaac

SEQ ID NO: 5237 - RNA, 19 nt, artificial
  Chemically Synthesized
acacaggcaaugaaauacu

SEQ ID NO: 5238 - RNA, 19 nt, artificial
  Chemically Synthesized
gcuuuucucuacaugaacc

SEQ ID NO: 5239 - RNA, 19 nt, artificial
  Chemically Synthesized
acuuuccuguggauaaaug

SEQ ID NO: 5240 - RNA, 19 nt, artificial
  Chemically Synthesized
uggauaaauggacagagua

SEQ ID NO: 5241 - RNA, 19 nt, artificial
  Chemically Synthesized
ugugaaguuacuuacagau

SEQ ID NO: 5242 - RNA, 19 nt, artificial
  Chemically Synthesized
accuggagugaucaccauu

SEQ ID NO: 5243 - RNA, 19 nt, artificial
  Chemically Synthesized
agugaucaccauucugcug

SEQ ID NO: 5244 - RNA, 19 nt, artificial
  Chemically Synthesized
ugcugaguaauuaacuggu

SEQ ID NO: 5245 - RNA, 19 nt, artificial
  Chemically Synthesized
guuugacaucuuucucccg

SEQ ID NO: 5246 - RNA, 19 nt, artificial
  Chemically Synthesized
uagauagcuugggagauca

SEQ ID NO: 5247 - RNA, 19 nt, artificial
  Chemically Synthesized
uccauuccaugaagucagc

SEQ ID NO: 5248 - RNA, 19 nt, artificial
  Chemically Synthesized
ccgaacaaaacaaagcgcc

SEQ ID NO: 5249 - RNA, 19 nt, artificial
  Chemically Synthesized
cuguuuacguuugacgucu

SEQ ID NO: 5250 - RNA, 19 nt, artificial
  Chemically Synthesized
guaacaauaauuggcaucu

SEQ ID NO: 5251 - RNA, 19 nt, artificial
  Chemically Synthesized
ucuacccaacacagcauuu

SEQ ID NO: 5252 - RNA, 19 nt, artificial
  Chemically Synthesized
aaugcacaaaacaugccac

SEQ ID NO: 5253 - RNA, 19 nt, artificial
  Chemically Synthesized
acaaaacaugccacuuugg

SEQ ID NO: 5254 - RNA, 19 nt, artificial
  Chemically Synthesized
cacagguacacuucaaaug

SEQ ID NO: 5255 - RNA, 19 nt, artificial
  Chemically Synthesized
acacuucaaaugguuuuuc

SEQ ID NO: 5256 - RNA, 19 nt, artificial
  Chemically Synthesized
ucucuacaugaaccuuccu

SEQ ID NO: 5257 - RNA, 19 nt, artificial
  Chemically Synthesized
uuuacacagcccgaaguga

SEQ ID NO: 5258 - RNA, 19 nt, artificial
  Chemically Synthesized
cacguuugacaucuuucuc

SEQ ID NO: 5259 - RNA, 19 nt, artificial
  Chemically Synthesized
uacuugcuguaaaucaaag

SEQ ID NO: 5260 - RNA, 19 nt, artificial
  Chemically Synthesized
uugcuguaaaucaaagcaa

SEQ ID NO: 5261 - RNA, 19 nt, artificial
  Chemically Synthesized
cuacauccaacgcuuuuag

SEQ ID NO: 5262 - RNA, 19 nt, artificial
  Chemically Synthesized
auguccauuccaugaaguc

SEQ ID NO: 5263 - RNA, 19 nt, artificial
  Chemically Synthesized
ucgccucuuccaugucucu

SEQ ID NO: 5264 - RNA, 19 nt, artificial
  Chemically Synthesized
cacaaaacaugccacuuug

SEQ ID NO: 5265 - RNA, 19 nt, artificial
  Chemically Synthesized
aaaacaugccacuuuggcu

SEQ ID NO: 5266 - RNA, 19 nt, artificial
  Chemically Synthesized
uuuaaaaaagccacaugca

SEQ ID NO: 5267 - RNA, 19 nt, artificial
  Chemically Synthesized
uacauccaacgcuuuuaga

SEQ ID NO: 5268 - RNA, 19 nt, artificial
  Chemically Synthesized
auccaacgcuuuuagaggc

SEQ ID NO: 5269 - RNA, 19 nt, artificial
  Chemically Synthesized
agaucauuuaagagugccu

SEQ ID NO: 5270 - RNA, 19 nt, artificial
  Chemically Synthesized
accgaacaaaacaaagcgc

SEQ ID NO: 5271 - RNA, 19 nt, artificial
  Chemically Synthesized
uucaucaagcagugaugua

SEQ ID NO: 5272 - RNA, 19 nt, artificial
  Chemically Synthesized
ucaucaagcagugauguau

SEQ ID NO: 5273 - RNA, 19 nt, artificial
  Chemically Synthesized
auucuuaauucgagcuguu

SEQ ID NO: 5274 - RNA, 19 nt, artificial
  Chemically Synthesized
ucgcuuccuuauuccugcg

SEQ ID NO: 5275 - RNA, 19 nt, artificial
  Chemically Synthesized
uccgcugaucaaauggacu

SEQ ID NO: 5276 - RNA, 19 nt, artificial
  Chemically Synthesized
cugaucaaauggacuggcg

SEQ ID NO: 5277 - RNA, 19 nt, artificial
  Chemically Synthesized
ugugauucugaaaaucgaa

SEQ ID NO: 5278 - RNA, 19 nt, artificial
  Chemically Synthesized
augucucugcagugcuucu

SEQ ID NO: 5279 - RNA, 19 nt, artificial
  Chemically Synthesized
uacuuggcucaguaugcaa

SEQ ID NO: 5280 - RNA, 19 nt, artificial
  Chemically Synthesized
aacacagcauuuacaaaug

SEQ ID NO: 5281 - RNA, 19 nt, artificial
  Chemically Synthesized
cugcagugcuucuccaagu

SEQ ID NO: 5282 - RNA, 19 nt, artificial
  Chemically Synthesized
cuuuggcuuguauauuguc

SEQ ID NO: 5283 - RNA, 19 nt, artificial
  Chemically Synthesized
cacuucaaaugguuuuucc

SEQ ID NO: 5284 - RNA, 19 nt, artificial
  Chemically Synthesized
aaugguuuuuccauacaca

SEQ ID NO: 5285 - RNA, 19 nt, artificial
  Chemically Synthesized
gguuuuuccauacacaggc

SEQ ID NO: 5286 - RNA, 19 nt, artificial
  Chemically Synthesized
ccuacaagugugcuuuucu

SEQ ID NO: 5287 - RNA, 19 nt, artificial
  Chemically Synthesized
aaaauaacacuuuccugug

SEQ ID NO: 5288 - RNA, 19 nt, artificial
  Chemically Synthesized
aauaacacuuuccugugga

SEQ ID NO: 5289 - RNA, 19 nt, artificial
  Chemically Synthesized
aauaaaagcagauggucaa

SEQ ID NO: 5290 - RNA, 19 nt, artificial
  Chemically Synthesized
aacauucaaaacucccaag

SEQ ID NO: 5291 - RNA, 19 nt, artificial
  Chemically Synthesized
ucucucgcacucucaaaaa

SEQ ID NO: 5292 - RNA, 19 nt, artificial
  Chemically Synthesized
cccaaaauugcuucucuuc

SEQ ID NO: 5293 - RNA, 19 nt, artificial
  Chemically Synthesized
cuguaaaucaaagcaagcu

SEQ ID NO: 5294 - RNA, 19 nt, artificial
  Chemically Synthesized
caaaaaaacaaaaccgaac

SEQ ID NO: 5295 - RNA, 19 nt, artificial
  Chemically Synthesized
aauucgagcuguuuacguu

SEQ ID NO: 5296 - RNA, 19 nt, artificial
  Chemically Synthesized
uacguuugacgucuucuga

SEQ ID NO: 5297 - RNA, 19 nt, artificial
  Chemically Synthesized
agaaucgucgguugcaggu

SEQ ID NO: 5298 - RNA, 19 nt, artificial
  Chemically Synthesized
aguagaacucgggcaagcu

SEQ ID NO: 5299 - RNA, 19 nt, artificial
  Chemically Synthesized
aauauggcgguggaaggga

SEQ ID NO: 5300 - RNA, 19 nt, artificial
  Chemically Synthesized
aauuggcaucuuuuucaca

SEQ ID NO: 5301 - RNA, 19 nt, artificial
  Chemically Synthesized
uggcaucuuuuucacacau

SEQ ID NO: 5302 - RNA, 19 nt, artificial
  Chemically Synthesized
caguaugcaaccuuuuaag

SEQ ID NO: 5303 - RNA, 19 nt, artificial
  Chemically Synthesized
acccaacacagcauuuaca

SEQ ID NO: 5304 - RNA, 19 nt, artificial
  Chemically Synthesized
acuuuggcuuguauauugu

SEQ ID NO: 5305 - RNA, 19 nt, artificial
  Chemically Synthesized
agucccggguuaacucuuc

SEQ ID NO: 5306 - RNA, 19 nt, artificial
  Chemically Synthesized
caaaacucccaagcaccuc

SEQ ID NO: 5307 - RNA, 19 nt, artificial
  Chemically Synthesized
ggagugaucaccauucugc

SEQ ID NO: 5308 - RNA, 19 nt, artificial
  Chemically Synthesized
aaaaaagccacaugcagcu

SEQ ID NO: 5309 - RNA, 19 nt, artificial
  Chemically Synthesized
ccaguguucaaauuuuugu

SEQ ID NO: 5310 - RNA, 19 nt, artificial
  Chemically Synthesized
aucagcugucucugaaagg

SEQ ID NO: 5311 - RNA, 19 nt, artificial
  Chemically Synthesized
guaaaucaaagcaagcucu

SEQ ID NO: 5312 - RNA, 19 nt, artificial
  Chemically Synthesized
cucucaaaaaaacaaaacc

SEQ ID NO: 5313 - RNA, 19 nt, artificial
  Chemically Synthesized
auauacacagguaguacaa

SEQ ID NO: 5314 - RNA, 19 nt, artificial
  Chemically Synthesized
aacaaaaccgaacaaaaca

SEQ ID NO: 5315 - RNA, 19 nt, artificial
  Chemically Synthesized
aucauuuaagagugccuaa

SEQ ID NO: 5316 - RNA, 19 nt, artificial
  Chemically Synthesized
agugauguaucugauaaac

SEQ ID NO: 5317 - RNA, 19 nt, artificial
  Chemically Synthesized
uguaucugauaaacaagga

SEQ ID NO: 5318 - RNA, 19 nt, artificial
  Chemically Synthesized
ccgcugaucaaauggacug

SEQ ID NO: 5319 - RNA, 19 nt, artificial
  Chemically Synthesized
caucuuuuucacacauuac

SEQ ID NO: 5320 - RNA, 19 nt, artificial
  Chemically Synthesized
uaugcaaccuuuuaagcau

SEQ ID NO: 5321 - RNA, 19 nt, artificial
  Chemically Synthesized
ugccacuuuggcuuguaua

SEQ ID NO: 5322 - RNA, 19 nt, artificial
  Chemically Synthesized
uguacacagguacacuuca

SEQ ID NO: 5323 - RNA, 19 nt, artificial
  Chemically Synthesized
gauaaauggacagaguaag

SEQ ID NO: 5324 - RNA, 19 nt, artificial
  Chemically Synthesized
agggcagugaggauagguu

SEQ ID NO: 5325 - RNA, 19 nt, artificial
  Chemically Synthesized
gaggauagguuucuguugc

SEQ ID NO: 5326 - RNA, 19 nt, artificial
  Chemically Synthesized
ugacaucuuucucccgggu

SEQ ID NO: 5327 - RNA, 19 nt, artificial
  Chemically Synthesized
gccaguguucaaauuuuug

SEQ ID NO: 5328 - RNA, 19 nt, artificial
  Chemically Synthesized
aaagggacauuacaucuuu

SEQ ID NO: 5329 - RNA, 19 nt, artificial
  Chemically Synthesized
cuucaugcaagucaaauau

SEQ ID NO: 5330 - RNA, 19 nt, artificial
  Chemically Synthesized
ucaaagcaagcucuucaua

SEQ ID NO: 5331 - RNA, 19 nt, artificial
  Chemically Synthesized
agagugccuaaaauuuuag

SEQ ID NO: 5332 - RNA, 19 nt, artificial
  Chemically Synthesized
guuguuguuuuucagugcu

SEQ ID NO: 5333 - RNA, 19 nt, artificial
  Chemically Synthesized
auacaggauguccauucca

SEQ ID NO: 5334 - RNA, 19 nt, artificial
  Chemically Synthesized
acguuugacgucuucugag

SEQ ID NO: 5335 - RNA, 19 nt, artificial
  Chemically Synthesized
uguaguagaacucgggcaa

SEQ ID NO: 5336 - RNA, 19 nt, artificial
  Chemically Synthesized
cucaguaugcaaccuuuua

SEQ ID NO: 5337 - RNA, 19 nt, artificial
  Chemically Synthesized
caacacagcauuuacaaau

SEQ ID NO: 5338 - RNA, 19 nt, artificial
  Chemically Synthesized
acacagguacacuucaaau

SEQ ID NO: 5339 - RNA, 19 nt, artificial
  Chemically Synthesized
auacacaggcaaugaaaua

SEQ ID NO: 5340 - RNA, 19 nt, artificial
  Chemically Synthesized
aaugugaaguuacuuacag

SEQ ID NO: 5341 - RNA, 19 nt, artificial
  Chemically Synthesized
gauagcuugggagaucacc

SEQ ID NO: 5342 - RNA, 19 nt, artificial
  Chemically Synthesized
ggacauuacaucuuuaaag

SEQ ID NO: 5343 - RNA, 19 nt, artificial
  Chemically Synthesized
ugcuucaucaagcagugau

SEQ ID NO: 5344 - RNA, 19 nt, artificial
  Chemically Synthesized
gugauguaucugauaaaca

SEQ ID NO: 5345 - RNA, 19 nt, artificial
  Chemically Synthesized
gagcuguuuacguuugacg

SEQ ID NO: 5346 - RNA, 19 nt, artificial
  Chemically Synthesized
guugcaggucgcuuccuua

SEQ ID NO: 5347 - RNA, 19 nt, artificial
  Chemically Synthesized
uccuguggauaaauggaca

SEQ ID NO: 5348 - RNA, 19 nt, artificial
  Chemically Synthesized
cuuuuuuuaguggcccaau

SEQ ID NO: 5349 - RNA, 19 nt, artificial
  Chemically Synthesized
agcagauggucaauucuua

SEQ ID NO: 5350 - RNA, 19 nt, artificial
  Chemically Synthesized
ccacaugcagcuaucuaac

SEQ ID NO: 5351 - RNA, 19 nt, artificial
  Chemically Synthesized
acuuuagauagcuugggag

SEQ ID NO: 5352 - RNA, 19 nt, artificial
  Chemically Synthesized
cucuucaugcaagucaaau

SEQ ID NO: 5353 - RNA, 19 nt, artificial
  Chemically Synthesized
augugcuacauaaaaggua

SEQ ID NO: 5354 - RNA, 19 nt, artificial
  Chemically Synthesized
uauacacagguaguacaau

SEQ ID NO: 5355 - RNA, 19 nt, artificial
  Chemically Synthesized
accuaauugcauaaugcua

SEQ ID NO: 5356 - RNA, 19 nt, artificial
  Chemically Synthesized
acgcuuuuagaggcagauc

SEQ ID NO: 5357 - RNA, 19 nt, artificial
  Chemically Synthesized
ugaagucagcgauauguau

SEQ ID NO: 5358 - RNA, 19 nt, artificial
  Chemically Synthesized
cuccacagaaccggcauuu

SEQ ID NO: 5359 - RNA, 19 nt, artificial
  Chemically Synthesized
aaaugcguguccucagagu

SEQ ID NO: 5360 - RNA, 19 nt, artificial
  Chemically Synthesized
cucuugccacucguacuug

SEQ ID NO: 5361 - RNA, 19 nt, artificial
  Chemically Synthesized
guuugugauucugaaaauc

SEQ ID NO: 5362 - RNA, 19 nt, artificial
  Chemically Synthesized
uuacagaguuauguacaca

SEQ ID NO: 5363 - RNA, 19 nt, artificial
  Chemically Synthesized
aagucccggguuaacucuu

SEQ ID NO: 5364 - RNA, 19 nt, artificial
  Chemically Synthesized
acacucgcacguuugacau

SEQ ID NO: 5365 - RNA, 19 nt, artificial
  Chemically Synthesized
caaacuaccuggagugauc

SEQ ID NO: 5366 - RNA, 19 nt, artificial
  Chemically Synthesized
gcacguuugacaucuuucu

SEQ ID NO: 5367 - RNA, 19 nt, artificial
  Chemically Synthesized
aaaagccacaugcagcuau

SEQ ID NO: 5368 - RNA, 19 nt, artificial
  Chemically Synthesized
cucucucgcacucucaaaa

SEQ ID NO: 5369 - RNA, 19 nt, artificial
  Chemically Synthesized
cagaucauuuaagagugcc

SEQ ID NO: 5370 - RNA, 19 nt, artificial
  Chemically Synthesized
uccaugaagucagcgauau

SEQ ID NO: 5371 - RNA, 19 nt, artificial
  Chemically Synthesized
gucagcgauauguauuuuu

SEQ ID NO: 5372 - RNA, 19 nt, artificial
  Chemically Synthesized
agaagaaucgucgguugca

SEQ ID NO: 5373 - RNA, 19 nt, artificial
  Chemically Synthesized
ggucgcuuccuuauuccug

SEQ ID NO: 5374 - RNA, 19 nt, artificial
  Chemically Synthesized
aauuauacuuggcucagua

SEQ ID NO: 5375 - RNA, 19 nt, artificial
  Chemically Synthesized
guacacuucaaaugguuuu

SEQ ID NO: 5376 - RNA, 19 nt, artificial
  Chemically Synthesized
aggcaaugaaauacuguuu

SEQ ID NO: 5377 - RNA, 19 nt, artificial
  Chemically Synthesized
aacacuuuccuguggauaa

SEQ ID NO: 5378 - RNA, 19 nt, artificial
  Chemically Synthesized
uguguuuacacagcccgaa

SEQ ID NO: 5379 - RNA, 19 nt, artificial
  Chemically Synthesized
caagcaccucggauuuuug

SEQ ID NO: 5380 - RNA, 19 nt, artificial
  Chemically Synthesized
auuccaacuuuaagagaga

SEQ ID NO: 5381 - RNA, 19 nt, artificial
  Chemically Synthesized
ugcuguaaaucaaagcaag

SEQ ID NO: 5382 - RNA, 19 nt, artificial
  Chemically Synthesized
acaaugaagcaaauaagga

SEQ ID NO: 5383 - RNA, 19 nt, artificial
  Chemically Synthesized
augcuacauccaacgcuuu

SEQ ID NO: 5384 - RNA, 19 nt, artificial
  Chemically Synthesized
agugcuuauacaggauguc

SEQ ID NO: 5385 - RNA, 19 nt, artificial
  Chemically Synthesized
cucggagccaaaagacaca

SEQ ID NO: 5386 - RNA, 19 nt, artificial
  Chemically Synthesized
cgucugaaacauuuucuuc

SEQ ID NO: 5387 - RNA, 19 nt, artificial
  Chemically Synthesized
ucuccgcugaucaaaugga

SEQ ID NO: 5388 - RNA, 19 nt, artificial
  Chemically Synthesized
gucuguaguagaacucggg

SEQ ID NO: 5389 - RNA, 19 nt, artificial
  Chemically Synthesized
aaauuauacuuggcucagu

SEQ ID NO: 5390 - RNA, 19 nt, artificial
  Chemically Synthesized
cagaguuauguacacaggu

SEQ ID NO: 5391 - RNA, 19 nt, artificial
  Chemically Synthesized
caagugugcuuuucucuac

SEQ ID NO: 5392 - RNA, 19 nt, artificial
  Chemically Synthesized
acaugaaccuuccuuuaaa

SEQ ID NO: 5393 - RNA, 19 nt, artificial
  Chemically Synthesized
aaauaucgagggauuuaga

SEQ ID NO: 5394 - RNA, 19 nt, artificial
  Chemically Synthesized
uacacagcccgaagugaaa

SEQ ID NO: 5395 - RNA, 19 nt, artificial
  Chemically Synthesized
aacugguaaauuccaacuu

SEQ ID NO: 5396 - RNA, 19 nt, artificial
  Chemically Synthesized
uaugugcuacauaaaaggu

SEQ ID NO: 5397 - RNA, 19 nt, artificial
  Chemically Synthesized
aaacaaaaccgaacaaaac

SEQ ID NO: 5398 - RNA, 19 nt, artificial
  Chemically Synthesized
cauauucuuaauucgagcu

SEQ ID NO: 5399 - RNA, 19 nt, artificial
  Chemically Synthesized
agcuguuuacguuugacgu

SEQ ID NO: 5400 - RNA, 19 nt, artificial
  Chemically Synthesized
caaaugcguguccucagag

SEQ ID NO: 5401 - RNA, 19 nt, artificial
  Chemically Synthesized
caaaacaugccacuuuggc

SEQ ID NO: 5402 - RNA, 19 nt, artificial
  Chemically Synthesized
ucuccaagucccggguuaa

SEQ ID NO: 5403 - RNA, 19 nt, artificial
  Chemically Synthesized
uccauacacaggcaaugaa

SEQ ID NO: 5404 - RNA, 19 nt, artificial
  Chemically Synthesized
guuaacucuucguggucca

SEQ ID NO: 5405 - RNA, 19 nt, artificial
  Chemically Synthesized
acugguaaauuccaacuuu

SEQ ID NO: 5406 - RNA, 19 nt, artificial
  Chemically Synthesized
acaugcagcuaucuaacaa

SEQ ID NO: 5407 - RNA, 19 nt, artificial
  Chemically Synthesized
cagcuaucuaacaaacuuu

SEQ ID NO: 5408 - RNA, 19 nt, artificial
  Chemically Synthesized
ugcauaaugcuacauccaa

SEQ ID NO: 5409 - RNA, 19 nt, artificial
  Chemically Synthesized
caggauguccauuccauga

SEQ ID NO: 5410 - RNA, 19 nt, artificial
  Chemically Synthesized
gauguaucugauaaacaag

SEQ ID NO: 5411 - RNA, 19 nt, artificial
  Chemically Synthesized
uguuuacguuugacgucuu

SEQ ID NO: 5412 - RNA, 19 nt, artificial
  Chemically Synthesized
guuuacguuugacgucuuc

SEQ ID NO: 5413 - RNA, 19 nt, artificial
  Chemically Synthesized
guagaagaaucgucgguug

SEQ ID NO: 5414 - RNA, 19 nt, artificial
  Chemically Synthesized
ccucuugccacucguacuu

SEQ ID NO: 5415 - RNA, 19 nt, artificial
  Chemically Synthesized
acuucaaaugguuuuucca

SEQ ID NO: 5416 - RNA, 19 nt, artificial
  Chemically Synthesized
aguauccauuucacuuauc

SEQ ID NO: 5417 - RNA, 19 nt, artificial
  Chemically Synthesized
cuuauccuacaagugugcu

SEQ ID NO: 5418 - RNA, 19 nt, artificial
  Chemically Synthesized
guuagacacucgcacguuu

SEQ ID NO: 5419 - RNA, 19 nt, artificial
  Chemically Synthesized
aucaccauucugcugagua

SEQ ID NO: 5420 - RNA, 19 nt, artificial
  Chemically Synthesized
cuuuuagaggcagaucauu

SEQ ID NO: 5421 - RNA, 19 nt, artificial
  Chemically Synthesized
ccguaaauguccauuuaua

SEQ ID NO: 5422 - RNA, 19 nt, artificial
  Chemically Synthesized
agcaaauggcagaaccaaa

SEQ ID NO: 5423 - RNA, 19 nt, artificial
  Chemically Synthesized
gccuuuuaacguagauaua

SEQ ID NO: 5424 - RNA, 19 nt, artificial
  Chemically Synthesized
cccgauugaaagaaccaga

SEQ ID NO: 5425 - RNA, 19 nt, artificial
  Chemically Synthesized
cgauugaaagaaccagaga

SEQ ID NO: 5426 - RNA, 19 nt, artificial
  Chemically Synthesized
gggaaacuuagaucaucag

SEQ ID NO: 5427 - RNA, 19 nt, artificial
  Chemically Synthesized
cucgggaaacuuagaucau

SEQ ID NO: 5428 - RNA, 19 nt, artificial
  Chemically Synthesized
aaaauguccugccuuuuaa

SEQ ID NO: 5429 - RNA, 19 nt, artificial
  Chemically Synthesized
caguaaccaugcccgcaua

SEQ ID NO: 5430 - RNA, 19 nt, artificial
  Chemically Synthesized
ggaaacuuagaucaucagu

SEQ ID NO: 5431 - RNA, 19 nt, artificial
  Chemically Synthesized
cauuuugugaacuagggaa

SEQ ID NO: 5432 - RNA, 19 nt, artificial
  Chemically Synthesized
cucugagaaaccucgggaa

SEQ ID NO: 5433 - RNA, 19 nt, artificial
  Chemically Synthesized
gcauuuugugaacuaggga

SEQ ID NO: 5434 - RNA, 19 nt, artificial
  Chemically Synthesized
cggaagcugucgacuucau

SEQ ID NO: 5435 - RNA, 19 nt, artificial
  Chemically Synthesized
ccagagaggcucugagaaa

SEQ ID NO: 5436 - RNA, 19 nt, artificial
  Chemically Synthesized
aaaccucgggaaacuuaga

SEQ ID NO: 5437 - RNA, 19 nt, artificial
  Chemically Synthesized
gguuacuggcuucucuuga

SEQ ID NO: 5438 - RNA, 19 nt, artificial
  Chemically Synthesized
cauucaugugggcauuucu

SEQ ID NO: 5439 - RNA, 19 nt, artificial
  Chemically Synthesized
uguccugccuuuuaacgua

SEQ ID NO: 5440 - RNA, 19 nt, artificial
  Chemically Synthesized
ccgcuuucguaguuuucau

SEQ ID NO: 5441 - RNA, 19 nt, artificial
  Chemically Synthesized
ccucgggaaacuuagauca

SEQ ID NO: 5442 - RNA, 19 nt, artificial
  Chemically Synthesized
uaccguaaauguccauuua

SEQ ID NO: 5443 - RNA, 19 nt, artificial
  Chemically Synthesized
ucgacuucaugacaagcau

SEQ ID NO: 5444 - RNA, 19 nt, artificial
  Chemically Synthesized
ccugccuuuuaacguagau

SEQ ID NO: 5445 - RNA, 19 nt, artificial
  Chemically Synthesized
cgacuucaugacaagcauu

SEQ ID NO: 5446 - RNA, 19 nt, artificial
  Chemically Synthesized
gaaaccucgggaaacuuag

SEQ ID NO: 5447 - RNA, 19 nt, artificial
  Chemically Synthesized
caccagaggcaguaaccau

SEQ ID NO: 5448 - RNA, 19 nt, artificial
  Chemically Synthesized
gccuuuucacuguguugga

SEQ ID NO: 5449 - RNA, 19 nt, artificial
  Chemically Synthesized
gcugucgacuucaugacaa

SEQ ID NO: 5450 - RNA, 19 nt, artificial
  Chemically Synthesized
gaagcugucgacuucauga

SEQ ID NO: 5451 - RNA, 19 nt, artificial
  Chemically Synthesized
gaguuuucuggagugagca

SEQ ID NO: 5452 - RNA, 19 nt, artificial
  Chemically Synthesized
ccacuaccguaaaugucca

SEQ ID NO: 5453 - RNA, 19 nt, artificial
  Chemically Synthesized
ugagucacacugcuagcaa

SEQ ID NO: 5454 - RNA, 19 nt, artificial
  Chemically Synthesized
cgcacauucaugugggcau

SEQ ID NO: 5455 - RNA, 19 nt, artificial
  Chemically Synthesized
ccgauugaaagaaccagag

SEQ ID NO: 5456 - RNA, 19 nt, artificial
  Chemically Synthesized
uaaccaugcccgcauagau

SEQ ID NO: 5457 - RNA, 19 nt, artificial
  Chemically Synthesized
acaagcauuuugugaacua

SEQ ID NO: 5458 - RNA, 19 nt, artificial
  Chemically Synthesized
gcuucugccuuuucacugu

SEQ ID NO: 5459 - RNA, 19 nt, artificial
  Chemically Synthesized
cuagcaaauggcagaacca

SEQ ID NO: 5460 - RNA, 19 nt, artificial
  Chemically Synthesized
ggaguuuucuggagugagc

SEQ ID NO: 5461 - RNA, 19 nt, artificial
  Chemically Synthesized
cucuugagucacacugcua

SEQ ID NO: 5462 - RNA, 19 nt, artificial
  Chemically Synthesized
caugacaagcauuuuguga

SEQ ID NO: 5463 - RNA, 19 nt, artificial
  Chemically Synthesized
aaaaauguccugccuuuua

SEQ ID NO: 5464 - RNA, 19 nt, artificial
  Chemically Synthesized
caagcauuuugugaacuag

SEQ ID NO: 5465 - RNA, 19 nt, artificial
  Chemically Synthesized
uguguuggaguuuucugga

SEQ ID NO: 5466 - RNA, 19 nt, artificial
  Chemically Synthesized
agaucaucagucaccgaag

SEQ ID NO: 5467 - RNA, 19 nt, artificial
  Chemically Synthesized
aaccagagaggcucugaga

SEQ ID NO: 5468 - RNA, 19 nt, artificial
  Chemically Synthesized
gcuucucuugagucacacu

SEQ ID NO: 5469 - RNA, 19 nt, artificial
  Chemically Synthesized
augacaagcauuuugugaa

SEQ ID NO: 5470 - RNA, 19 nt, artificial
  Chemically Synthesized
cgcuuucguaguuuucauu

SEQ ID NO: 5471 - RNA, 19 nt, artificial
  Chemically Synthesized
gauugaaagaaccagagag

SEQ ID NO: 5472 - RNA, 19 nt, artificial
  Chemically Synthesized
acuggcuucucuugaguca

SEQ ID NO: 5473 - RNA, 19 nt, artificial
  Chemically Synthesized
cccuaagcgcacauucaug

SEQ ID NO: 5474 - RNA, 19 nt, artificial
  Chemically Synthesized
cugccuuuuaacguagaua

SEQ ID NO: 5475 - RNA, 19 nt, artificial
  Chemically Synthesized
ugccuuuuaacguagauau

SEQ ID NO: 5476 - RNA, 19 nt, artificial
  Chemically Synthesized
uccugccuuuuaacguaga

SEQ ID NO: 5477 - RNA, 19 nt, artificial
  Chemically Synthesized
uagcaaauggcagaaccaa

SEQ ID NO: 5478 - RNA, 19 nt, artificial
  Chemically Synthesized
cacuguguuggaguuuucu

SEQ ID NO: 5479 - RNA, 19 nt, artificial
  Chemically Synthesized
gcacauucaugugggcauu

SEQ ID NO: 5480 - RNA, 19 nt, artificial
  Chemically Synthesized
cacuaccguaaauguccau

SEQ ID NO: 5481 - RNA, 19 nt, artificial
  Chemically Synthesized
uaacguagauauaugccuu

SEQ ID NO: 5482 - RNA, 19 nt, artificial
  Chemically Synthesized
ugugaacuagggaagcuca

SEQ ID NO: 5483 - RNA, 19 nt, artificial
  Chemically Synthesized
aaauguccugccuuuuaac

SEQ ID NO: 5484 - RNA, 19 nt, artificial
  Chemically Synthesized
ugacaagcauuuugugaac

SEQ ID NO: 5485 - RNA, 19 nt, artificial
  Chemically Synthesized
cugucgacuucaugacaag

SEQ ID NO: 5486 - RNA, 19 nt, artificial
  Chemically Synthesized
ccuaagcgcacauucaugu

SEQ ID NO: 5487 - RNA, 19 nt, artificial
  Chemically Synthesized
acugcuagcaaauggcaga

SEQ ID NO: 5488 - RNA, 19 nt, artificial
  Chemically Synthesized
ggguuacuggcuucucuug

SEQ ID NO: 5489 - RNA, 19 nt, artificial
  Chemically Synthesized
accagagaggcucugagaa

SEQ ID NO: 5490 - RNA, 19 nt, artificial
  Chemically Synthesized
agcugucgacuucaugaca

SEQ ID NO: 5491 - RNA, 19 nt, artificial
  Chemically Synthesized
ccgcuucugccuuuucacu

SEQ ID NO: 5492 - RNA, 19 nt, artificial
  Chemically Synthesized
cuaccguaaauguccauuu

SEQ ID NO: 5493 - RNA, 19 nt, artificial
  Chemically Synthesized
uuaaaaauguccugccuuu

SEQ ID NO: 5494 - RNA, 19 nt, artificial
  Chemically Synthesized
gagcuuuuaaaaauguccu

SEQ ID NO: 5495 - RNA, 19 nt, artificial
  Chemically Synthesized
ggaagcugucgacuucaug

SEQ ID NO: 5496 - RNA, 19 nt, artificial
  Chemically Synthesized
uguuggaguuuucuggagu

SEQ ID NO: 5497 - RNA, 19 nt, artificial
  Chemically Synthesized
aaagaaaaacaccgcuucu

SEQ ID NO: 5498 - RNA, 19 nt, artificial
  Chemically Synthesized
gaucaucagucaccgaagg

SEQ ID NO: 5499 - RNA, 19 nt, artificial
  Chemically Synthesized
ucucuugagucacacugcu

SEQ ID NO: 5500 - RNA, 19 nt, artificial
  Chemically Synthesized
cccgcuuucguaguuuuca

SEQ ID NO: 5501 - RNA, 19 nt, artificial
  Chemically Synthesized
cugcuagcaaauggcagaa

SEQ ID NO: 5502 - RNA, 19 nt, artificial
  Chemically Synthesized
ggcuucucuugagucacac

SEQ ID NO: 5503 - RNA, 19 nt, artificial
  Chemically Synthesized
uagaucaucagucaccgaa

SEQ ID NO: 5504 - RNA, 19 nt, artificial
  Chemically Synthesized
agucacacugcuagcaaau

SEQ ID NO: 5505 - RNA, 19 nt, artificial
  Chemically Synthesized
ucaugacaagcauuuugug

SEQ ID NO: 5506 - RNA, 19 nt, artificial
  Chemically Synthesized
auucaugugggcauuucuu

SEQ ID NO: 5507 - RNA, 19 nt, artificial
  Chemically Synthesized
guuggaguuuucuggagug

SEQ ID NO: 5508 - RNA, 19 nt, artificial
  Chemically Synthesized
cuguguuggaguuuucugg

SEQ ID NO: 5509 - RNA, 19 nt, artificial
  Chemically Synthesized
agucaccgaagguccuaca

SEQ ID NO: 5510 - RNA, 19 nt, artificial
  Chemically Synthesized
ucuugagucacacugcuag

SEQ ID NO: 5511 - RNA, 19 nt, artificial
  Chemically Synthesized
uuagaucaucagucaccga

SEQ ID NO: 5512 - RNA, 19 nt, artificial
  Chemically Synthesized
gaaacuuagaucaucaguc

SEQ ID NO: 5513 - RNA, 19 nt, artificial
  Chemically Synthesized
guguuggaguuuucuggag

SEQ ID NO: 5514 - RNA, 19 nt, artificial
  Chemically Synthesized
uuuucacuguguuggaguu

SEQ ID NO: 5515 - RNA, 19 nt, artificial
  Chemically Synthesized
accguaaauguccauuuau

SEQ ID NO: 5516 - RNA, 19 nt, artificial
  Chemically Synthesized
guaaccaugcccgcauaga

SEQ ID NO: 5517 - RNA, 19 nt, artificial
  Chemically Synthesized
aaaaaagaaaaacaccgcu

SEQ ID NO: 5518 - RNA, 19 nt, artificial
  Chemically Synthesized
agcauuuugugaacuaggg

SEQ ID NO: 5519 - RNA, 19 nt, artificial
  Chemically Synthesized
uggaguuuucuggagugag

SEQ ID NO: 5520 - RNA, 19 nt, artificial
  Chemically Synthesized
uaaaaauguccugccuuuu

SEQ ID NO: 5521 - RNA, 19 nt, artificial
  Chemically Synthesized
cugagaaaccucgggaaac

SEQ ID NO: 5522 - RNA, 19 nt, artificial
  Chemically Synthesized
gagaggcucugagaaaccu

SEQ ID NO: 5523 - RNA, 19 nt, artificial
  Chemically Synthesized
accagaggcaguaaccaug

SEQ ID NO: 5524 - RNA, 19 nt, artificial
  Chemically Synthesized
acacugcuagcaaauggca

SEQ ID NO: 5525 - RNA, 19 nt, artificial
  Chemically Synthesized
cuuuucacuguguuggagu

SEQ ID NO: 5526 - RNA, 19 nt, artificial
  Chemically Synthesized
accgcuucugccuuuucac

SEQ ID NO: 5527 - RNA, 19 nt, artificial
  Chemically Synthesized
cuugagucacacugcuagc

SEQ ID NO: 5528 - RNA, 19 nt, artificial
  Chemically Synthesized
gugaacuagggaagcucag

SEQ ID NO: 5529 - RNA, 19 nt, artificial
  Chemically Synthesized
augugggcauuucuugcga

SEQ ID NO: 5530 - RNA, 19 nt, artificial
  Chemically Synthesized
uuggaguuuucuggaguga

SEQ ID NO: 5531 - RNA, 19 nt, artificial
  Chemically Synthesized
ucacuguguuggaguuuuc

SEQ ID NO: 5532 - RNA, 19 nt, artificial
  Chemically Synthesized
aaaaagaaaaacaccgcuu

SEQ ID NO: 5533 - RNA, 19 nt, artificial
  Chemically Synthesized
cguagauauaugccuuccc

SEQ ID NO: 5534 - RNA, 19 nt, artificial
  Chemically Synthesized
agaaccagagaggcucuga

SEQ ID NO: 5535 - RNA, 19 nt, artificial
  Chemically Synthesized
cacugcuagcaaauggcag

SEQ ID NO: 5536 - RNA, 19 nt, artificial
  Chemically Synthesized
aagcauuuugugaacuagg

SEQ ID NO: 5537 - RNA, 19 nt, artificial
  Chemically Synthesized
uuuuaaaaauguccugccu

SEQ ID NO: 5538 - RNA, 19 nt, artificial
  Chemically Synthesized
cagagaggcucugagaaac

SEQ ID NO: 5539 - RNA, 19 nt, artificial
  Chemically Synthesized
auuucuugcgagccucgca

SEQ ID NO: 5540 - RNA, 19 nt, artificial
  Chemically Synthesized
ccuuuucacuguguuggag

SEQ ID NO: 5541 - RNA, 19 nt, artificial
  Chemically Synthesized
guccugccuuuuaacguag

SEQ ID NO: 5542 - RNA, 19 nt, artificial
  Chemically Synthesized
aucagucaccgaagguccu

SEQ ID NO: 5543 - RNA, 19 nt, artificial
  Chemically Synthesized
aaccucgggaaacuuagau

SEQ ID NO: 5544 - RNA, 19 nt, artificial
  Chemically Synthesized
aaccaugcccgcauagaug

SEQ ID NO: 5545 - RNA, 19 nt, artificial
  Chemically Synthesized
agcuuuuaaaaauguccug

SEQ ID NO: 5546 - RNA, 19 nt, artificial
  Chemically Synthesized
cuggcuucucuugagucac

SEQ ID NO: 5547 - RNA, 19 nt, artificial
  Chemically Synthesized
aaaacaccgcuucugccuu

SEQ ID NO: 5548 - RNA, 19 nt, artificial
  Chemically Synthesized
caaauggcagaaccaaagc

SEQ ID NO: 5549 - RNA, 19 nt, artificial
  Chemically Synthesized
ucugccuuuucacuguguu

SEQ ID NO: 5550 - RNA, 19 nt, artificial
  Chemically Synthesized
cccacuaccguaaaugucc

SEQ ID NO: 5551 - RNA, 19 nt, artificial
  Chemically Synthesized
gcuuucguaguuuucauuu

SEQ ID NO: 5552 - RNA, 19 nt, artificial
  Chemically Synthesized
aaagaaccagagaggcucu

SEQ ID NO: 5553 - RNA, 19 nt, artificial
  Chemically Synthesized
gcuagcaaauggcagaacc

SEQ ID NO: 5554 - RNA, 19 nt, artificial
  Chemically Synthesized
cugccuuuucacuguguug

SEQ ID NO: 5555 - RNA, 19 nt, artificial
  Chemically Synthesized
aaaagaaaaacaccgcuuc

SEQ ID NO: 5556 - RNA, 19 nt, artificial
  Chemically Synthesized
gacaagcauuuugugaacu

SEQ ID NO: 5557 - RNA, 19 nt, artificial
  Chemically Synthesized
uuuaaaaauguccugccuu

SEQ ID NO: 5558 - RNA, 19 nt, artificial
  Chemically Synthesized
ucagucaccgaagguccua

SEQ ID NO: 5559 - RNA, 19 nt, artificial
  Chemically Synthesized
ugaaagaaccagagaggcu

SEQ ID NO: 5560 - RNA, 19 nt, artificial
  Chemically Synthesized
ugugggcauuucuugcgag

SEQ ID NO: 5561 - RNA, 19 nt, artificial
  Chemically Synthesized
agagcuuuuaaaaaugucc

SEQ ID NO: 5562 - RNA, 19 nt, artificial
  Chemically Synthesized
guuuucuggagugagcacu

SEQ ID NO: 5563 - RNA, 19 nt, artificial
  Chemically Synthesized
aacaccgcuucugccuuuu

SEQ ID NO: 5564 - RNA, 19 nt, artificial
  Chemically Synthesized
gaaaaacaccgcuucugcc

SEQ ID NO: 5565 - RNA, 19 nt, artificial
  Chemically Synthesized
auguccugccuuuuaacgu

SEQ ID NO: 5566 - RNA, 19 nt, artificial
  Chemically Synthesized
auuuugugaacuagggaag

SEQ ID NO: 5567 - RNA, 19 nt, artificial
  Chemically Synthesized
gucgacuucaugacaagca

SEQ ID NO: 5568 - RNA, 19 nt, artificial
  Chemically Synthesized
acuguguuggaguuuucug

SEQ ID NO: 5569 - RNA, 19 nt, artificial
  Chemically Synthesized
uucacuguguuggaguuuu

SEQ ID NO: 5570 - RNA, 19 nt, artificial
  Chemically Synthesized
uugagucacacugcuagca

SEQ ID NO: 5571 - RNA, 19 nt, artificial
  Chemically Synthesized
acuucaugacaagcauuuu

SEQ ID NO: 5572 - RNA, 19 nt, artificial
  Chemically Synthesized
guaaaaaagaaaaacaccg

SEQ ID NO: 5573 - RNA, 19 nt, artificial
  Chemically Synthesized
gaaagaaccagagaggcuc

SEQ ID NO: 5574 - RNA, 19 nt, artificial
  Chemically Synthesized
uucaugacaagcauuuugu

SEQ ID NO: 5575 - RNA, 19 nt, artificial
  Chemically Synthesized
cuucaugacaagcauuuug

SEQ ID NO: 5576 - RNA, 19 nt, artificial
  Chemically Synthesized
uuucuggagugagcacuca

SEQ ID NO: 5577 - RNA, 19 nt, artificial
  Chemically Synthesized
cuucugccuuuucacugug

SEQ ID NO: 5578 - RNA, 19 nt, artificial
  Chemically Synthesized
accucgggaaacuuagauc

SEQ ID NO: 5579 - RNA, 19 nt, artificial
  Chemically Synthesized
agaaaaacaccgcuucugc

SEQ ID NO: 5580 - RNA, 19 nt, artificial
  Chemically Synthesized
uuaacguagauauaugccu

SEQ ID NO: 5581 - RNA, 19 nt, artificial
  Chemically Synthesized
cuuagaucaucagucaccg

SEQ ID NO: 5582 - RNA, 19 nt, artificial
  Chemically Synthesized
agaggcucugagaaaccuc

SEQ ID NO: 5583 - RNA, 19 nt, artificial
  Chemically Synthesized
cacacugcuagcaaauggc

SEQ ID NO: 5584 - RNA, 19 nt, artificial
  Chemically Synthesized
cacauucaugugggcauuu

SEQ ID NO: 5585 - RNA, 19 nt, artificial
  Chemically Synthesized
aagcgcacauucauguggg

SEQ ID NO: 5586 - RNA, 19 nt, artificial
  Chemically Synthesized
aaaaacaccgcuucugccu

SEQ ID NO: 5587 - RNA, 19 nt, artificial
  Chemically Synthesized
aguuuucuggagugagcac

SEQ ID NO: 5588 - RNA, 19 nt, artificial
  Chemically Synthesized
uucugccuuuucacugugu

SEQ ID NO: 5589 - RNA, 19 nt, artificial
  Chemically Synthesized
cuuuuaaaaauguccugcc

SEQ ID NO: 5590 - RNA, 19 nt, artificial
  Chemically Synthesized
aaauggcagaaccaaagcu

SEQ ID NO: 5591 - RNA, 19 nt, artificial
  Chemically Synthesized
cgcuucugccuuuucacug

SEQ ID NO: 5592 - RNA, 19 nt, artificial
  Chemically Synthesized
aguaaccaugcccgcauag

SEQ ID NO: 5593 - RNA, 19 nt, artificial
  Chemically Synthesized
ucaugugggcauuucuugc

SEQ ID NO: 5594 - RNA, 19 nt, artificial
  Chemically Synthesized
acuaccguaaauguccauu

SEQ ID NO: 5595 - RNA, 19 nt, artificial
  Chemically Synthesized
acauucaugugggcauuuc

SEQ ID NO: 5596 - RNA, 19 nt, artificial
  Chemically Synthesized
cuucucuugagucacacug

SEQ ID NO: 5597 - RNA, 19 nt, artificial
  Chemically Synthesized
cuaagcgcacauucaugug

SEQ ID NO: 5598 - RNA, 19 nt, artificial
  Chemically Synthesized
acaccgcuucugccuuuuc

SEQ ID NO: 5599 - RNA, 19 nt, artificial
  Chemically Synthesized
gcuuuuaaaaauguccugc

SEQ ID NO: 5600 - RNA, 19 nt, artificial
  Chemically Synthesized
ucaucagucaccgaagguc

SEQ ID NO: 5601 - RNA, 19 nt, artificial
  Chemically Synthesized
ugaacuagggaagcucagg

SEQ ID NO: 5602 - RNA, 19 nt, artificial
  Chemically Synthesized
uucaugugggcauuucuug

SEQ ID NO: 5603 - RNA, 19 nt, artificial
  Chemically Synthesized
aacguagauauaugccuuc

SEQ ID NO: 5604 - RNA, 19 nt, artificial
  Chemically Synthesized
agagaggcucugagaaacc

SEQ ID NO: 5605 - RNA, 19 nt, artificial
  Chemically Synthesized
aucaucagucaccgaaggu

SEQ ID NO: 5606 - RNA, 19 nt, artificial
  Chemically Synthesized
uuugugaacuagggaagcu

SEQ ID NO: 5607 - RNA, 19 nt, artificial
  Chemically Synthesized
uucuggagugagcacucac

SEQ ID NO: 5608 - RNA, 19 nt, artificial
  Chemically Synthesized
aacuuagaucaucagucac

SEQ ID NO: 5609 - RNA, 19 nt, artificial
  Chemically Synthesized
uucucuugagucacacugc

SEQ ID NO: 5610 - RNA, 19 nt, artificial
  Chemically Synthesized
uuuugugaacuagggaagc

SEQ ID NO: 5611 - RNA, 19 nt, artificial
  Chemically Synthesized
auugaaagaaccagagagg

SEQ ID NO: 5612 - RNA, 19 nt, artificial
  Chemically Synthesized
aagcugucgacuucaugac

SEQ ID NO: 5613 - RNA, 19 nt, artificial
  Chemically Synthesized
uaaaaaagaaaaacaccgc

SEQ ID NO: 5614 - RNA, 19 nt, artificial
  Chemically Synthesized
uacuggcuucucuugaguc

SEQ ID NO: 5615 - RNA, 19 nt, artificial
  Chemically Synthesized
acguagauauaugccuucc

SEQ ID NO: 5616 - RNA, 19 nt, artificial
  Chemically Synthesized
uuucacuguguuggaguuu

SEQ ID NO: 5617 - RNA, 19 nt, artificial
  Chemically Synthesized
aauguccugccuuuuaacg

SEQ ID NO: 5618 - RNA, 19 nt, artificial
  Chemically Synthesized
uuuucuggagugagcacuc

SEQ ID NO: 5619 - RNA, 19 nt, artificial
  Chemically Synthesized
ugucgacuucaugacaagc

SEQ ID NO: 5620 - RNA, 19 nt, artificial
  Chemically Synthesized
caugugggcauuucuugcg

SEQ ID NO: 5621 - RNA, 19 nt, artificial
  Chemically Synthesized
aagaaaaacaccgcuucug

SEQ ID NO: 5622 - RNA, 19 nt, artificial
  Chemically Synthesized
uugugaacuagggaagcuc

SEQ ID NO: 5623 - RNA, 19 nt, artificial
  Chemically Synthesized
ugcuagcaaauggcagaac

SEQ ID NO: 5624 - RNA, 19 nt, artificial
  Chemically Synthesized
acuuagaucaucagucacc

SEQ ID NO: 5625 - RNA, 19 nt, artificial
  Chemically Synthesized
gucacacugcuagcaaaug

SEQ ID NO: 5626 - RNA, 19 nt, artificial
  Chemically Synthesized
aauggcagaaccaaagcuc

SEQ ID NO: 5627 - RNA, 19 nt, artificial
  Chemically Synthesized
aagaaccagagaggcucug

SEQ ID NO: 5628 - RNA, 19 nt, artificial
  Chemically Synthesized
uugaaagaaccagagaggc

SEQ ID NO: 5629 - RNA, 19 nt, artificial
  Chemically Synthesized
ugccuuuucacuguguugg

SEQ ID NO: 5630 - RNA, 19 nt, artificial
  Chemically Synthesized
uaagcgcacauucaugugg

SEQ ID NO: 5631 - RNA, 19 nt, artificial
  Chemically Synthesized
uuuaacguagauauaugcc

SEQ ID NO: 5632 - RNA, 19 nt, artificial
  Chemically Synthesized
uauaaauggacauuuacgg

SEQ ID NO: 5633 - RNA, 19 nt, artificial
  Chemically Synthesized
uuugguucugccauuugcu

SEQ ID NO: 5634 - RNA, 19 nt, artificial
  Chemically Synthesized
uauaucuacguuaaaaggc

SEQ ID NO: 5635 - RNA, 19 nt, artificial
  Chemically Synthesized
ucugguucuuucaaucggg

SEQ ID NO: 5636 - RNA, 19 nt, artificial
  Chemically Synthesized
ucucugguucuuucaaucg

SEQ ID NO: 5637 - RNA, 19 nt, artificial
  Chemically Synthesized
cugaugaucuaaguuuccc

SEQ ID NO: 5638 - RNA, 19 nt, artificial
  Chemically Synthesized
augaucuaaguuucccgag

SEQ ID NO: 5639 - RNA, 19 nt, artificial
  Chemically Synthesized
uuaaaaggcaggacauuuu

SEQ ID NO: 5640 - RNA, 19 nt, artificial
  Chemically Synthesized
uaugcgggcaugguuacug

SEQ ID NO: 5641 - RNA, 19 nt, artificial
  Chemically Synthesized
acugaugaucuaaguuucc

SEQ ID NO: 5642 - RNA, 19 nt, artificial
  Chemically Synthesized
uucccuaguucacaaaaug

SEQ ID NO: 5643 - RNA, 19 nt, artificial
  Chemically Synthesized
uucccgagguuucucagag

SEQ ID NO: 5644 - RNA, 19 nt, artificial
  Chemically Synthesized
ucccuaguucacaaaaugc

SEQ ID NO: 5645 - RNA, 19 nt, artificial
  Chemically Synthesized
augaagucgacagcuuccg

SEQ ID NO: 5646 - RNA, 19 nt, artificial
  Chemically Synthesized
uuucucagagccucucugg

SEQ ID NO: 5647 - RNA, 19 nt, artificial
  Chemically Synthesized
ucuaaguuucccgagguuu

SEQ ID NO: 5648 - RNA, 19 nt, artificial
  Chemically Synthesized
ucaagagaagccaguaacc

SEQ ID NO: 5649 - RNA, 19 nt, artificial
  Chemically Synthesized
agaaaugcccacaugaaug

SEQ ID NO: 5650 - RNA, 19 nt, artificial
  Chemically Synthesized
uacguuaaaaggcaggaca

SEQ ID NO: 5651 - RNA, 19 nt, artificial
  Chemically Synthesized
augaaaacuacgaaagcgg

SEQ ID NO: 5652 - RNA, 19 nt, artificial
  Chemically Synthesized
ugaucuaaguuucccgagg

SEQ ID NO: 5653 - RNA, 19 nt, artificial
  Chemically Synthesized
uaaauggacauuuacggua

SEQ ID NO: 5654 - RNA, 19 nt, artificial
  Chemically Synthesized
augcuugucaugaagucga

SEQ ID NO: 5655 - RNA, 19 nt, artificial
  Chemically Synthesized
aucuacguuaaaaggcagg

SEQ ID NO: 5656 - RNA, 19 nt, artificial
  Chemically Synthesized
aaugcuugucaugaagucg

SEQ ID NO: 5657 - RNA, 19 nt, artificial
  Chemically Synthesized
cuaaguuucccgagguuuc

SEQ ID NO: 5658 - RNA, 19 nt, artificial
  Chemically Synthesized
augguuacugccucuggug

SEQ ID NO: 5659 - RNA, 19 nt, artificial
  Chemically Synthesized
uccaacacagugaaaaggc

SEQ ID NO: 5660 - RNA, 19 nt, artificial
  Chemically Synthesized
uugucaugaagucgacagc

SEQ ID NO: 5661 - RNA, 19 nt, artificial
  Chemically Synthesized
ucaugaagucgacagcuuc

SEQ ID NO: 5662 - RNA, 19 nt, artificial
  Chemically Synthesized
ugcucacuccagaaaacuc

SEQ ID NO: 5663 - RNA, 19 nt, artificial
  Chemically Synthesized
uggacauuuacgguagugg

SEQ ID NO: 5664 - RNA, 19 nt, artificial
  Chemically Synthesized
uugcuagcagugugacuca

SEQ ID NO: 5665 - RNA, 19 nt, artificial
  Chemically Synthesized
augcccacaugaaugugcg

SEQ ID NO: 5666 - RNA, 19 nt, artificial
  Chemically Synthesized
cucugguucuuucaaucgg

SEQ ID NO: 5667 - RNA, 19 nt, artificial
  Chemically Synthesized
aucuaugcgggcaugguua

SEQ ID NO: 5668 - RNA, 19 nt, artificial
  Chemically Synthesized
uaguucacaaaaugcuugu

SEQ ID NO: 5669 - RNA, 19 nt, artificial
  Chemically Synthesized
acagugaaaaggcagaagc

SEQ ID NO: 5670 - RNA, 19 nt, artificial
  Chemically Synthesized
ugguucugccauuugcuag

SEQ ID NO: 5671 - RNA, 19 nt, artificial
  Chemically Synthesized
gcucacuccagaaaacucc

SEQ ID NO: 5672 - RNA, 19 nt, artificial
  Chemically Synthesized
uagcagugugacucaagag

SEQ ID NO: 5673 - RNA, 19 nt, artificial
  Chemically Synthesized
ucacaaaaugcuugucaug

SEQ ID NO: 5674 - RNA, 19 nt, artificial
  Chemically Synthesized
uaaaaggcaggacauuuuu

SEQ ID NO: 5675 - RNA, 19 nt, artificial
  Chemically Synthesized
cuaguucacaaaaugcuug

SEQ ID NO: 5676 - RNA, 19 nt, artificial
  Chemically Synthesized
uccagaaaacuccaacaca

SEQ ID NO: 5677 - RNA, 19 nt, artificial
  Chemically Synthesized
cuucggugacugaugaucu

SEQ ID NO: 5678 - RNA, 19 nt, artificial
  Chemically Synthesized
ucucagagccucucugguu

SEQ ID NO: 5679 - RNA, 19 nt, artificial
  Chemically Synthesized
agugugacucaagagaagc

SEQ ID NO: 5680 - RNA, 19 nt, artificial
  Chemically Synthesized
uucacaaaaugcuugucau

SEQ ID NO: 5681 - RNA, 19 nt, artificial
  Chemically Synthesized
aaugaaaacuacgaaagcg

SEQ ID NO: 5682 - RNA, 19 nt, artificial
  Chemically Synthesized
cucucugguucuuucaauc

SEQ ID NO: 5683 - RNA, 19 nt, artificial
  Chemically Synthesized
ugacucaagagaagccagu

SEQ ID NO: 5684 - RNA, 19 nt, artificial
  Chemically Synthesized
caugaaugugcgcuuaggg

SEQ ID NO: 5685 - RNA, 19 nt, artificial
  Chemically Synthesized
uaucuacguuaaaaggcag

SEQ ID NO: 5686 - RNA, 19 nt, artificial
  Chemically Synthesized
auaucuacguuaaaaggca

SEQ ID NO: 5687 - RNA, 19 nt, artificial
  Chemically Synthesized
ucuacguuaaaaggcagga

SEQ ID NO: 5688 - RNA, 19 nt, artificial
  Chemically Synthesized
uugguucugccauuugcua

SEQ ID NO: 5689 - RNA, 19 nt, artificial
  Chemically Synthesized
agaaaacuccaacacagug

SEQ ID NO: 5690 - RNA, 19 nt, artificial
  Chemically Synthesized
aaugcccacaugaaugugc

SEQ ID NO: 5691 - RNA, 19 nt, artificial
  Chemically Synthesized
auggacauuuacgguagug

SEQ ID NO: 5692 - RNA, 19 nt, artificial
  Chemically Synthesized
aaggcauauaucuacguua

SEQ ID NO: 5693 - RNA, 19 nt, artificial
  Chemically Synthesized
ugagcuucccuaguucaca

SEQ ID NO: 5694 - RNA, 19 nt, artificial
  Chemically Synthesized
guuaaaaggcaggacauuu

SEQ ID NO: 5695 - RNA, 19 nt, artificial
  Chemically Synthesized
guucacaaaaugcuuguca

SEQ ID NO: 5696 - RNA, 19 nt, artificial
  Chemically Synthesized
cuugucaugaagucgacag

SEQ ID NO: 5697 - RNA, 19 nt, artificial
  Chemically Synthesized
acaugaaugugcgcuuagg

SEQ ID NO: 5698 - RNA, 19 nt, artificial
  Chemically Synthesized
ucugccauuugcuagcagu

SEQ ID NO: 5699 - RNA, 19 nt, artificial
  Chemically Synthesized
caagagaagccaguaaccc

SEQ ID NO: 5700 - RNA, 19 nt, artificial
  Chemically Synthesized
uucucagagccucucuggu

SEQ ID NO: 5701 - RNA, 19 nt, artificial
  Chemically Synthesized
ugucaugaagucgacagcu

SEQ ID NO: 5702 - RNA, 19 nt, artificial
  Chemically Synthesized
agugaaaaggcagaagcgg

SEQ ID NO: 5703 - RNA, 19 nt, artificial
  Chemically Synthesized
aaauggacauuuacgguag

SEQ ID NO: 5704 - RNA, 19 nt, artificial
  Chemically Synthesized
aaaggcaggacauuuuuaa

SEQ ID NO: 5705 - RNA, 19 nt, artificial
  Chemically Synthesized
aggacauuuuuaaaagcuc

SEQ ID NO: 5706 - RNA, 19 nt, artificial
  Chemically Synthesized
caugaagucgacagcuucc

SEQ ID NO: 5707 - RNA, 19 nt, artificial
  Chemically Synthesized
acuccagaaaacuccaaca

SEQ ID NO: 5708 - RNA, 19 nt, artificial
  Chemically Synthesized
agaagcgguguuuuucuuu

SEQ ID NO: 5709 - RNA, 19 nt, artificial
  Chemically Synthesized
ccuucggugacugaugauc

SEQ ID NO: 5710 - RNA, 19 nt, artificial
  Chemically Synthesized
agcagugugacucaagaga

SEQ ID NO: 5711 - RNA, 19 nt, artificial
  Chemically Synthesized
ugaaaacuacgaaagcggg

SEQ ID NO: 5712 - RNA, 19 nt, artificial
  Chemically Synthesized
uucugccauuugcuagcag

SEQ ID NO: 5713 - RNA, 19 nt, artificial
  Chemically Synthesized
gugugacucaagagaagcc

SEQ ID NO: 5714 - RNA, 19 nt, artificial
  Chemically Synthesized
uucggugacugaugaucua

SEQ ID NO: 5715 - RNA, 19 nt, artificial
  Chemically Synthesized
auuugcuagcagugugacu

SEQ ID NO: 5716 - RNA, 19 nt, artificial
  Chemically Synthesized
cacaaaaugcuugucauga

SEQ ID NO: 5717 - RNA, 19 nt, artificial
  Chemically Synthesized
aagaaaugcccacaugaau

SEQ ID NO: 5718 - RNA, 19 nt, artificial
  Chemically Synthesized
cacuccagaaaacuccaac

SEQ ID NO: 5719 - RNA, 19 nt, artificial
  Chemically Synthesized
ccagaaaacuccaacacag

SEQ ID NO: 5720 - RNA, 19 nt, artificial
  Chemically Synthesized
uguaggaccuucggugacu

SEQ ID NO: 5721 - RNA, 19 nt, artificial
  Chemically Synthesized
cuagcagugugacucaaga

SEQ ID NO: 5722 - RNA, 19 nt, artificial
  Chemically Synthesized
ucggugacugaugaucuaa

SEQ ID NO: 5723 - RNA, 19 nt, artificial
  Chemically Synthesized
gacugaugaucuaaguuuc

SEQ ID NO: 5724 - RNA, 19 nt, artificial
  Chemically Synthesized
cuccagaaaacuccaacac

SEQ ID NO: 5725 - RNA, 19 nt, artificial
  Chemically Synthesized
aacuccaacacagugaaaa

SEQ ID NO: 5726 - RNA, 19 nt, artificial
  Chemically Synthesized
auaaauggacauuuacggu

SEQ ID NO: 5727 - RNA, 19 nt, artificial
  Chemically Synthesized
ucuaugcgggcaugguuac

SEQ ID NO: 5728 - RNA, 19 nt, artificial
  Chemically Synthesized
agcgguguuuuucuuuuuu

SEQ ID NO: 5729 - RNA, 19 nt, artificial
  Chemically Synthesized
cccuaguucacaaaaugcu

SEQ ID NO: 5730 - RNA, 19 nt, artificial
  Chemically Synthesized
cucacuccagaaaacucca

SEQ ID NO: 5731 - RNA, 19 nt, artificial
  Chemically Synthesized
aaaaggcaggacauuuuua

SEQ ID NO: 5732 - RNA, 19 nt, artificial
  Chemically Synthesized
guuucccgagguuucucag

SEQ ID NO: 5733 - RNA, 19 nt, artificial
  Chemically Synthesized
agguuucucagagccucuc

SEQ ID NO: 5734 - RNA, 19 nt, artificial
  Chemically Synthesized
caugguuacugccucuggu

SEQ ID NO: 5735 - RNA, 19 nt, artificial
  Chemically Synthesized
ugccauuugcuagcagugu

SEQ ID NO: 5736 - RNA, 19 nt, artificial
  Chemically Synthesized
acuccaacacagugaaaag

SEQ ID NO: 5737 - RNA, 19 nt, artificial
  Chemically Synthesized
gugaaaaggcagaagcggu

SEQ ID NO: 5738 - RNA, 19 nt, artificial
  Chemically Synthesized
gcuagcagugugacucaag

SEQ ID NO: 5739 - RNA, 19 nt, artificial
  Chemically Synthesized
cugagcuucccuaguucac

SEQ ID NO: 5740 - RNA, 19 nt, artificial
  Chemically Synthesized
ucgcaagaaaugcccacau

SEQ ID NO: 5741 - RNA, 19 nt, artificial
  Chemically Synthesized
ucacuccagaaaacuccaa

SEQ ID NO: 5742 - RNA, 19 nt, artificial
  Chemically Synthesized
gaaaacuccaacacaguga

SEQ ID NO: 5743 - RNA, 19 nt, artificial
  Chemically Synthesized
aagcgguguuuuucuuuuu

SEQ ID NO: 5744 - RNA, 19 nt, artificial
  Chemically Synthesized
gggaaggcauauaucuacg

SEQ ID NO: 5745 - RNA, 19 nt, artificial
  Chemically Synthesized
ucagagccucucugguucu

SEQ ID NO: 5746 - RNA, 19 nt, artificial
  Chemically Synthesized
cugccauuugcuagcagug

SEQ ID NO: 5747 - RNA, 19 nt, artificial
  Chemically Synthesized
ccuaguucacaaaaugcuu

SEQ ID NO: 5748 - RNA, 19 nt, artificial
  Chemically Synthesized
aggcaggacauuuuuaaaa

SEQ ID NO: 5749 - RNA, 19 nt, artificial
  Chemically Synthesized
guuucucagagccucucug

SEQ ID NO: 5750 - RNA, 19 nt, artificial
  Chemically Synthesized
ugcgaggcucgcaagaaau

SEQ ID NO: 5751 - RNA, 19 nt, artificial
  Chemically Synthesized
cuccaacacagugaaaagg

SEQ ID NO: 5752 - RNA, 19 nt, artificial
  Chemically Synthesized
cuacguuaaaaggcaggac

SEQ ID NO: 5753 - RNA, 19 nt, artificial
  Chemically Synthesized
aggaccuucggugacugau

SEQ ID NO: 5754 - RNA, 19 nt, artificial
  Chemically Synthesized
aucuaaguuucccgagguu

SEQ ID NO: 5755 - RNA, 19 nt, artificial
  Chemically Synthesized
caucuaugcgggcaugguu

SEQ ID NO: 5756 - RNA, 19 nt, artificial
  Chemically Synthesized
caggacauuuuuaaaagcu

SEQ ID NO: 5757 - RNA, 19 nt, artificial
  Chemically Synthesized
gugacucaagagaagccag

SEQ ID NO: 5758 - RNA, 19 nt, artificial
  Chemically Synthesized
aaggcagaagcgguguuuu

SEQ ID NO: 5759 - RNA, 19 nt, artificial
  Chemically Synthesized
gcuuugguucugccauuug

SEQ ID NO: 5760 - RNA, 19 nt, artificial
  Chemically Synthesized
aacacagugaaaaggcaga

SEQ ID NO: 5761 - RNA, 19 nt, artificial
  Chemically Synthesized
ggacauuuacgguaguggg

SEQ ID NO: 5762 - RNA, 19 nt, artificial
  Chemically Synthesized
aaaugaaaacuacgaaagc

SEQ ID NO: 5763 - RNA, 19 nt, artificial
  Chemically Synthesized
agagccucucugguucuuu

SEQ ID NO: 5764 - RNA, 19 nt, artificial
  Chemically Synthesized
gguucugccauuugcuagc

SEQ ID NO: 5765 - RNA, 19 nt, artificial
  Chemically Synthesized
caacacagugaaaaggcag

SEQ ID NO: 5766 - RNA, 19 nt, artificial
  Chemically Synthesized
gaagcgguguuuuucuuuu

SEQ ID NO: 5767 - RNA, 19 nt, artificial
  Chemically Synthesized
aguucacaaaaugcuuguc

SEQ ID NO: 5768 - RNA, 19 nt, artificial
  Chemically Synthesized
aaggcaggacauuuuuaaa

SEQ ID NO: 5769 - RNA, 19 nt, artificial
  Chemically Synthesized
uaggaccuucggugacuga

SEQ ID NO: 5770 - RNA, 19 nt, artificial
  Chemically Synthesized
agccucucugguucuuuca

SEQ ID NO: 5771 - RNA, 19 nt, artificial
  Chemically Synthesized
cucgcaagaaaugcccaca

SEQ ID NO: 5772 - RNA, 19 nt, artificial
  Chemically Synthesized
ggacauuuuuaaaagcucu

SEQ ID NO: 5773 - RNA, 19 nt, artificial
  Chemically Synthesized
agugcucacuccagaaaac

SEQ ID NO: 5774 - RNA, 19 nt, artificial
  Chemically Synthesized
aaaaggcagaagcgguguu

SEQ ID NO: 5775 - RNA, 19 nt, artificial
  Chemically Synthesized
ggcagaagcgguguuuuuc

SEQ ID NO: 5776 - RNA, 19 nt, artificial
  Chemically Synthesized
acguuaaaaggcaggacau

SEQ ID NO: 5777 - RNA, 19 nt, artificial
  Chemically Synthesized
cuucccuaguucacaaaau

SEQ ID NO: 5778 - RNA, 19 nt, artificial
  Chemically Synthesized
ugcuugucaugaagucgac

SEQ ID NO: 5779 - RNA, 19 nt, artificial
  Chemically Synthesized
cagaaaacuccaacacagu

SEQ ID NO: 5780 - RNA, 19 nt, artificial
  Chemically Synthesized
aaaacuccaacacagugaa

SEQ ID NO: 5781 - RNA, 19 nt, artificial
  Chemically Synthesized
ugcuagcagugugacucaa

SEQ ID NO: 5782 - RNA, 19 nt, artificial
  Chemically Synthesized
aaaaugcuugucaugaagu

SEQ ID NO: 5783 - RNA, 19 nt, artificial
  Chemically Synthesized
cgguguuuuucuuuuuuac

SEQ ID NO: 5784 - RNA, 19 nt, artificial
  Chemically Synthesized
gagccucucugguucuuuc

SEQ ID NO: 5785 - RNA, 19 nt, artificial
  Chemically Synthesized
acaaaaugcuugucaugaa

SEQ ID NO: 5786 - RNA, 19 nt, artificial
  Chemically Synthesized
caaaaugcuugucaugaag

SEQ ID NO: 5787 - RNA, 19 nt, artificial
  Chemically Synthesized
ugagugcucacuccagaaa

SEQ ID NO: 5788 - RNA, 19 nt, artificial
  Chemically Synthesized
cacagugaaaaggcagaag

SEQ ID NO: 5789 - RNA, 19 nt, artificial
  Chemically Synthesized
gaucuaaguuucccgaggu

SEQ ID NO: 5790 - RNA, 19 nt, artificial
  Chemically Synthesized
gcagaagcgguguuuuucu

SEQ ID NO: 5791 - RNA, 19 nt, artificial
  Chemically Synthesized
aggcauauaucuacguuaa

SEQ ID NO: 5792 - RNA, 19 nt, artificial
  Chemically Synthesized
cggugacugaugaucuaag

SEQ ID NO: 5793 - RNA, 19 nt, artificial
  Chemically Synthesized
gagguuucucagagccucu

SEQ ID NO: 5794 - RNA, 19 nt, artificial
  Chemically Synthesized
gccauuugcuagcagugug

SEQ ID NO: 5795 - RNA, 19 nt, artificial
  Chemically Synthesized
aaaugcccacaugaaugug

SEQ ID NO: 5796 - RNA, 19 nt, artificial
  Chemically Synthesized
cccacaugaaugugcgcuu

SEQ ID NO: 5797 - RNA, 19 nt, artificial
  Chemically Synthesized
aggcagaagcgguguuuuu

SEQ ID NO: 5798 - RNA, 19 nt, artificial
  Chemically Synthesized
gugcucacuccagaaaacu

SEQ ID NO: 5799 - RNA, 19 nt, artificial
  Chemically Synthesized
acacagugaaaaggcagaa

SEQ ID NO: 5800 - RNA, 19 nt, artificial
  Chemically Synthesized
ggcaggacauuuuuaaaag

SEQ ID NO: 5801 - RNA, 19 nt, artificial
  Chemically Synthesized
agcuuugguucugccauuu

SEQ ID NO: 5802 - RNA, 19 nt, artificial
  Chemically Synthesized
cagugaaaaggcagaagcg

SEQ ID NO: 5803 - RNA, 19 nt, artificial
  Chemically Synthesized
cuaugcgggcaugguuacu

SEQ ID NO: 5804 - RNA, 19 nt, artificial
  Chemically Synthesized
gcaagaaaugcccacauga

SEQ ID NO: 5805 - RNA, 19 nt, artificial
  Chemically Synthesized
aauggacauuuacgguagu

SEQ ID NO: 5806 - RNA, 19 nt, artificial
  Chemically Synthesized
gaaaugcccacaugaaugu

SEQ ID NO: 5807 - RNA, 19 nt, artificial
  Chemically Synthesized
cagugugacucaagagaag

SEQ ID NO: 5808 - RNA, 19 nt, artificial
  Chemically Synthesized
cacaugaaugugcgcuuag

SEQ ID NO: 5809 - RNA, 19 nt, artificial
  Chemically Synthesized
gaaaaggcagaagcggugu

SEQ ID NO: 5810 - RNA, 19 nt, artificial
  Chemically Synthesized
gcaggacauuuuuaaaagc

SEQ ID NO: 5811 - RNA, 19 nt, artificial
  Chemically Synthesized
gaccuucggugacugauga

SEQ ID NO: 5812 - RNA, 19 nt, artificial
  Chemically Synthesized
ccugagcuucccuaguuca

SEQ ID NO: 5813 - RNA, 19 nt, artificial
  Chemically Synthesized
caagaaaugcccacaugaa

SEQ ID NO: 5814 - RNA, 19 nt, artificial
  Chemically Synthesized
gaaggcauauaucuacguu

SEQ ID NO: 5815 - RNA, 19 nt, artificial
  Chemically Synthesized
gguuucucagagccucucu

SEQ ID NO: 5816 - RNA, 19 nt, artificial
  Chemically Synthesized
accuucggugacugaugau

SEQ ID NO: 5817 - RNA, 19 nt, artificial
  Chemically Synthesized
agcuucccuaguucacaaa

SEQ ID NO: 5818 - RNA, 19 nt, artificial
  Chemically Synthesized
gugagugcucacuccagaa

SEQ ID NO: 5819 - RNA, 19 nt, artificial
  Chemically Synthesized
gugacugaugaucuaaguu

SEQ ID NO: 5820 - RNA, 19 nt, artificial
  Chemically Synthesized
gcagugugacucaagagaa

SEQ ID NO: 5821 - RNA, 19 nt, artificial
  Chemically Synthesized
gcuucccuaguucacaaaa

SEQ ID NO: 5822 - RNA, 19 nt, artificial
  Chemically Synthesized
ccucucugguucuuucaau

SEQ ID NO: 5823 - RNA, 19 nt, artificial
  Chemically Synthesized
gucaugaagucgacagcuu

SEQ ID NO: 5824 - RNA, 19 nt, artificial
  Chemically Synthesized
gcgguguuuuucuuuuuua

SEQ ID NO: 5825 - RNA, 19 nt, artificial
  Chemically Synthesized
gacucaagagaagccagua

SEQ ID NO: 5826 - RNA, 19 nt, artificial
  Chemically Synthesized
ggaaggcauauaucuacgu

SEQ ID NO: 5827 - RNA, 19 nt, artificial
  Chemically Synthesized
aaacuccaacacagugaaa

SEQ ID NO: 5828 - RNA, 19 nt, artificial
  Chemically Synthesized
cguuaaaaggcaggacauu

SEQ ID NO: 5829 - RNA, 19 nt, artificial
  Chemically Synthesized
gagugcucacuccagaaaa

SEQ ID NO: 5830 - RNA, 19 nt, artificial
  Chemically Synthesized
gcuugucaugaagucgaca

SEQ ID NO: 5831 - RNA, 19 nt, artificial
  Chemically Synthesized
cgcaagaaaugcccacaug

SEQ ID NO: 5832 - RNA, 19 nt, artificial
  Chemically Synthesized
cagaagcgguguuuuucuu

SEQ ID NO: 5833 - RNA, 19 nt, artificial
  Chemically Synthesized
gagcuucccuaguucacaa

SEQ ID NO: 5834 - RNA, 19 nt, artificial
  Chemically Synthesized
guucugccauuugcuagca

SEQ ID NO: 5835 - RNA, 19 nt, artificial
  Chemically Synthesized
ggugacugaugaucuaagu

SEQ ID NO: 5836 - RNA, 19 nt, artificial
  Chemically Synthesized
cauuugcuagcagugugac

SEQ ID NO: 5837 - RNA, 19 nt, artificial
  Chemically Synthesized
gagcuuugguucugccauu

SEQ ID NO: 5838 - RNA, 19 nt, artificial
  Chemically Synthesized
cagagccucucugguucuu

SEQ ID NO: 5839 - RNA, 19 nt, artificial
  Chemically Synthesized
gccucucugguucuuucaa

SEQ ID NO: 5840 - RNA, 19 nt, artificial
  Chemically Synthesized
ccaacacagugaaaaggca

SEQ ID NO: 5841 - RNA, 19 nt, artificial
  Chemically Synthesized
ccacaugaaugugcgcuua

SEQ ID NO: 5842 - RNA, 19 nt, artificial
  Chemically Synthesized
ggcauauaucuacguuaaa

SEQ ID NO: 5843 - RNA, 19 nt, Artificial
  Chemically synthesized
gugccaaccugaugcagcu

SEQ ID NO: 5844 - RNA, 19 nt, Artificial
  Chemically synthesized
agcugcaucagguuggcac

SEQ ID NO: 5845 - RNA, 19 nt, Artificial
  Chemically synthesized
gaagaaaauuuccgcaaaa

SEQ ID NO: 5846 - RNA, 19 nt, Artificial
  Chemically synthesized
uuuugcggaaauuuucuuc

SEQ ID NO: 5847 - RNA, 19 nt, Artificial
  Chemically synthesized
gccagaauguggaacuccu

SEQ ID NO: 5848 - RNA, 19 nt, Artificial
  Chemically synthesized
aggaguuccacauucuggc

The invention claimed is:

1. An otic pharmaceutical composition comprising: (a) a therapeutically effective amount of a double-stranded siRNA compound which down-regulates the expression of a human CASP2 gene in the inner ear and/or in the middle ear, wherein the CASP2 gene encodes a mRNA having a sequence set forth in any one of SEQ ID NOS:8-9 and wherein each strand of the siRNA compound is independently between 18 and 40 nucleotides in length; (b) 5% to 20% (v/v) glycerol; and (c) a pharmaceutically acceptable excipient or carrier.

2. The otic pharmaceutical composition of claim 1, comprising glycerol at a final concentration of about 7% to about 13% (v/v) of the composition.

3. The otic pharmaceutical composition of claim 2, comprising glycerol at a final concentration of about 10% (v/v) of the composition.

4. The otic pharmaceutical composition of claim 1, wherein the doubl-stranded siRNA compound is selected from the group consisting of an unmodified siRNA and a chemically modified siRNA.

5. The otic pharmaceutical composition of claim 4, wherein the double-stranded siRNA compound is a chemically modified siRNA.

6. The otic pharmaceutical composition of claim 5, wherein the chemically modified siRNA comprises an RNA duplex comprising a first strand and a second strand,
wherein the first strand comprises an oligoribonucleotide sequence complementary or substantially complementary to about 18 to about 40 consecutive nucleotides of the mRNA, and the second strand comprises an oligoribonuleotide sequence complementary or substantially complementary to the first strand; and
wherein said first strand or said second strand comprises one or more chemically modified ribonucleotides and/or unconventional moieties.

7. The otic pharmaceutical composition of claim 1, wherein the therapeutically effective amount of the siRNA comprises between 0.1 mg/ml to 100 mg/ml.

8. The otic pharmaceutical composition of claim 7, wherein the therapeutically effective amount comprises between 1 mg/ml to 50 mg/ml.

9. The otic pharmaceutical composition of claim 8, wherein the therapeutically effective amount comprises between 5 mg/ml to 20 mg/ml.

10. The otic pharmaceutical composition of claim 1, wherein such composition is designed for topical non-invasive administration.

11. The otic pharmaceutical composition of claim 10, wherein such composition is designed for deposition into the ear canal.

12. The otic pharmaceutical composition of claim 11, wherein the composition is formulated as a liquid solution.

13. The otic pharmaceutical composition of claim 12, wherein the composition is formulated as eardrops.

14. The otic pharmaceutical composition of claim 6, wherein the chemically modified siRNA has the structure:

```
5'  (N)ₓ-Z      3'          (antisense strand)
3'  Z'-(N')ᵧ-z" 5'          (sense strand)
```

wherein each of N and N' is a ribonucleotide which may be unmodified or modified, or an unconventional moiety and wherein the siRNA comprises at least one modified ribonucleotide or unconventional moiety;

wherein each of (N)x and (N')y is an oligonucleotide in which each consecutive N or N' is joined to the next N or N' by a covalent bond;

wherein Z and Z' may be present or absent, but if present is independently 1 to 5 consecutive nucleotides covalently attached at the 3' terminus of the strand in which it is present;

wherein z" may be present or absent, but if present is a capping moiety covalently attached at the 5' terminus of (N')y;

wherein each of x and y is independently an integer between 18 and 40;

wherein the sequence of (N')y is substantially complementary to the sequence of (N)x; and wherein (N)x comprises an antisense sequence substantially complementary to from about 18 to about 40 consecutive in an mRNA.

15. The otic pharmaceutical composition of claim 1, wherein both strands of the double-stranded siRNA compound are 19 nucleotides in length.

16. The otic pharmaceutical composition of claim 14, wherein x=y=19.

17. The otic pharmaceutical composition of claim 16, wherein both of z and z' are absent.

18. The otic pharmaceutical composition of claim 16, wherein both of z and z' is present.

* * * * *